US008828355B2

(12) United States Patent
Keller et al.

(10) Patent No.: US 8,828,355 B2
(45) Date of Patent: Sep. 9, 2014

(54) IMAGING REPORTERS OF TRANSGENE EXPRESSION

(75) Inventors: Charles Keller, San Antonio, TX (US); Patrick J. Hawkes, Bountiful, UT (US)

(73) Assignee: University of Utah Research Foundation, Salt Lake City, UT (US)

(*) Notice: Subject to any disclaimer, the term of this patent is extended or adjusted under 35 U.S.C. 154(b) by 882 days.

(21) Appl. No.: 11/575,057

(22) PCT Filed: Sep. 16, 2005

(86) PCT No.: PCT/US2005/033073
§ 371 (c)(1),
(2), (4) Date: Jan. 29, 2008

(87) PCT Pub. No.: WO2006/034005
PCT Pub. Date: Mar. 30, 2006

(65) Prior Publication Data
US 2008/0260646 A1    Oct. 23, 2008

Related U.S. Application Data

(60) Provisional application No. 60/610,681, filed on Sep. 17, 2004.

(51) Int. Cl.
*A61K 51/00* (2006.01)
*A61M 36/14* (2006.01)
*A61K 51/04* (2006.01)

(52) U.S. Cl.
CPC ......... *A61K 51/0497* (2013.01); *A61K 51/0491* (2013.01); *A61K 51/04* (2013.01)
USPC ......... 424/1.73; 424/1.11; 424/1.65; 424/9.1; 424/9.6

(58) Field of Classification Search
CPC ... A61K 49/00; A61K 49/001; A61K 49/003; A61K 49/0017; A61K 49/0019; A61K 49/0021; A61K 49/0032; A61K 49/0034; A61K 49/005; A61K 31/00; A61K 9/00; A61K 51/0491; A61K 51/04; A61K 51/0493; A61K 51/0497
USPC ........... 424/1.11, 1.49, 1.65, 1.69, 1.73, 1.81, 424/1.85, 1.89, 9.1, 9.2, 9.3, 9.4, 9.5, 9.6, 424/9.7, 9.8
See application file for complete search history.

(56) References Cited

U.S. PATENT DOCUMENTS

| 5,468,468 | A |   | 11/1995 | LaRochelle et al. |
| 5,807,708 | A | * | 9/1998 | Falb et al. .................... 435/69.1 |
| 6,309,827 | B1 |   | 10/2001 | Goldstein et al. |
| 2002/0073441 | A1 |   | 6/2002 | Ross et al. |
| 2003/0022198 | A1 |   | 1/2003 | Kaelin et al. |

FOREIGN PATENT DOCUMENTS

| WO | WO-00/71565 A3 | 11/2000 |
| WO | WO-01/12234 | 2/2001 |
| WO | WO-02/32292 | 4/2002 |
| WO | WO-03/011020 | 2/2003 |

OTHER PUBLICATIONS

Bolo et al., "Brian Pharmacokinetics and Tissue Distribution In Vivo of Fluvoxamine and Fluoxetine by Fluorine Magnetic Resonance Spectroscopy," Neuropsychopharmacology, vol. 23, No. 4, pp. 428-438 (2000).
Great Britain IPO: Examination Report under Section 18(3) for application No. GB0707274.7 dated Jan. 15, 2009.
International Search Report for PCT/US05/33073 dated Mar. 3, 2006.
Office Action issued in Canadian Patent Application No. 2,580,644 and dated Mar. 20, 2012.
European Patent Office Action for Application No. 05812543.6 dated Apr. 25, 2013 (6 pages).
Blasberg et al., "Molecular-genetic imaging: current and future perspectives," J. Clin. Invest. vol. 111; No. 11; pp. 1620-1629; (2003).
Extended European Search Report and Search Opinion for EP Pat. Appl. No. 05812543.6 issued on Mar. 11, 2011; 19 pages.
Fukushi et al., "[18F]-6-Fluoro-9-alkylpurines: A potential Radiotracer for Measuring Brain Glutathione-S-Transferase by PET," Symposium Abstracts; Division of Clinical Research, National Institute of Radiological Sciences; Chiba, Japan, 94 pages; (Mar. 1995).
Maclaren et al., "Repetitive, non-invasive imaging of the dopamine D2 receptor as a reporter gene in living animals," Gene Therapy vol. 6; pp. 785-791; (1999).
Moore, et al., "In Vivo Targeting of Underglycosylated MUC-1 Tumor Antigen Using a Multimodal Imaging Probe," Cancer Research, vol. 64; pp. 1821-1827; (Mar. 1, 2004).
Notice of Reasons for Rejection issued by the Japan Patent Office for JP Pat. Appl. No. 2007-532481 on Apr. 18, 2011; 7 pages (with English translation).
Weissleder et al., "In vivo magnetic resonance imaging of transgene expression," Nature Medicine vol. 6; No. 3; pp. 351-354; (Mar. 2000).

* cited by examiner

*Primary Examiner* — D L Jones
(74) *Attorney, Agent, or Firm* — Michael Best & Friedrich LLP

(57) ABSTRACT

Disclosed are compositions and methods for imaging in animals.

23 Claims, 11 Drawing Sheets

TABLE I
Kinetic constants for the hydrolysis of synthetic thioester substrates by human protein D and $\overline{C1s}$
0.1 M HEPES buffer at pH 7.5, 0.5 M NaCl, and 9.8% Me$_2$SO, 25 °C. Protein D concentration: 10-18 nM.

| Substrate | | | | | | Substrate concentration range | Protein D | | | $\overline{C1s}^a$ |
|---|---|---|---|---|---|---|---|---|---|---|
| P$_5$ | P$_4$ | P$_3$ | P$_2$ | P$_1$ | P$_1'$ | | $k_{cat}$ | $K_m$ | $k_{cat}/K_m$ | ($k_{cat}/K_m$) |
| | | | | | | mM | s$^{-1}$ | mM | M$^{-1}$s$^{-1}$ | M$^{-1}$s$^{-1}$ |
| | | | | Z-Arg | -SBzl | 0.17-0.83 | 0.64 | 3.7 | 170 | ND$^b$ |
| | | | Z-Lys | -Arg | -SBzl | 0.16-0.81 | | | 2,100 | ND |
| | | | Z-Lys | -Arg | -SBu-i | 0.096-0.48 | 1.0 | 2.5 | 2,500 | 160,000 |
| | | | Z-Val | -Arg | -SBu-i | 0.13-0.25 | 3.6 | 1.75 | 2,450 | 460,000 |
| | | | Z-Arg | -Arg | -SBzl | 0.17-0.69 | | | 1,400 | ND |
| | | | Z-Gly | -Arg | -SBu-i | 0.20 | | NH$^c$ | | 730,000 |
| | | | Z-Ala | -Arg | -SBu-i | 0.12 | | NH | | 880,000 |
| | | | Z-Trp | -Arg | -SBu-i | 0.069 | | NH | | 140,000 |
| | | | Z-Pro | -Arg | -SBu-i | 0.042$^d$ | | NH | | 220,000 |
| | | | Z-Thr | -Arg | -SBu-i | 0.089 | | NH | | 210,000 |
| | | | Z-Asn | -Arg | -SBu-i | 0.016 | | NH | | 120,000 |
| | | | Z-Glu | -Arg | -SBu-i | 0.057 | | NH | | 170,000 |
| | | MeO-Suc | -Lys | -Arg | -SBzl | 0.25-0.77 | | | 260 | ND |
| | | Boc-Val | -Phe | -Arg | -SBzl | 0.033-0.083 | | | 2,700$^e$ | ND |
| | | Z-Leu | -Ala | -Arg | -SBzl | 0.18 | | NH | | 800,000 |
| | Z-Gly | -Leu | -Ala | -Arg | -SBzl | 0.12 | | NH | | 60,000 |
| Z-Leu | -Gly | -Leu | -Ala | -Arg | -SBzl | 0.18 | | NH | | 160,000 |
| | | Z-Leu | -Gly | -Arg | -SBzl | 0.21 | | NH | | 1,200,000 |
| | Z-Gln | -Leu | -Gly | -Arg | -SBzl | 0.23 | | NH | | 1,300,000 |
| Z-Met | -Gln | -Leu | -Gly | -Arg | -SBzl | 0.14 | | NH | | 1,700,000 |
| | | | Z-Gln | -Arg | -SBzl | 0.19 | | SH | | 460,000 |
| | | Z-Leu | -Gln | -Arg | -SBzl | 0.14 | | NH | | 460,000 |
| | Gly | -Leu | -Gln | -Arg | -SBzl | 0.15 | | NH | | 200,000 |
| Z-Met | -Gly | -Leu | -Gln | -Arg | -SBzl | 0.051 | | NH | | 230,000 |

$^a$ Data obtained from McRae et al. (1981b). Kinetic constants were measured at pH 7.5, 30 °C.
$^b$ ND, not determined.
$^c$ NH, no hydrolysis.
$^d$ 5% Me$_2$SO and Ellman's reagent were used in the assay.
$^e$ 2.5% v/v Me$_2$SO.
$^f$ Slow hydrolysis was detected, but no kinetic constants could be obtained due to insufficient substrate.

TABLE II
Kinetic constants for the hydrolysis of synthetic thioester substrates by human protein C2 and fragment C2a
0.1 M HEPES buffer at pH 7.5, 0.5 M NaCl, and 9.8% Me$_2$SO, 25 °C. Enzyme concentrations: 14 nM C2, 14 nM C2a.

| Substrate | | | | | | Substrate concentration range | C2 | C2a | | | ($k_{cat}/K_m$)C2a |
|---|---|---|---|---|---|---|---|---|---|---|---|
| P$_5$ | P$_4$ | P$_3$ | P$_2$ | P$_1$ | P$_1'$ | | $k_{cat}/K_m$ | $k_{cat}$ | $K_m$ | $k_{cat}/K_m$ | ($k_{cat}/K_m$)C2 |
| | | | | | | mM | M$^{-1}$s$^{-1}$ | s$^{-1}$ | mM | M$^{-1}$s$^{-1}$ | |
| | | | Z-Ala | -Arg | -SBu-i | 0.09 | NH$^a$ | | NH | | |
| | | | Z-Gly | -Arg | -SBu-i | 0.15 | NH | | NH | | |
| | | | Z-Lys | -Arg | -SBu-i | 0.54 | NH | | NH | | |
| | | | Z-Lys | -Arg | -SBzl | 0.43 | NH | | NH | | |
| | | MeO-Suc | -Lys | -Arg | -SBzl | 0.21 | NH | | NH | | |
| | | Z-Leu | -Ala | -Arg | -SBzl | 0.03-0.18 | 3,650 | 1.66 | 0.24 | 7,040 | 1.9 |
| | Z-Gly | -Leu | -Ala | -Arg | -SBzl | 0.02-0.12 | 8,820 | 2.34 | 0.30 | 7,910 | 0.9 |
| Z-Leu | -Gly | -Leu | -Ala | -Arg | -SBzl | 0.02-0.18 | 3,170 | 0.60 | 0.05 | 12,180 | 3.8 |
| | | | Z-Gln | -Arg | -SBzl | 0.19 | NH | | NH | | |
| | | Z-Leu | -Gln | -Arg | -SBzl | 0.14 | NH | | NH | | |
| | Z-Gly | -Leu | -Gln | -Arg | -SBzl | 0.30 | 380 | | NH | | |
| | | Z-Leu | -Gly | -Arg | -SBzl | 0.10-0.21 | 1,950 | | | 4,060 | 2.1 |
| | Z-Gln | -Leu | -Gly | -Arg | -SBzl | 0.10-0.22 | 3,430 | | | 3,340 | 1.0 |
| Z-Met | -Gln | -Leu | -Gly | -Arg | -SBzl | 0.08-0.18 | 1,540 | | | 1,860 | 1.2 |

$^a$ NH, no hydrolysis.

FIG. 4B

TABLE III

*Kinetic constants for the hydrolysis of synthetic thioester substrates by human protein B and fragment Bb*

0.1 M HEPES buffer at pH 7.5, 0.5 M NaCl, and 9.8% Me$_2$SO, 25 °C. Enzyme concentrations: 14 nM B, 20 nM Bb.

| Substrate | | | | | | Substrate concentration range | B | | | Bb | | | $(k_{cat}/K_m)$Bb |
|---|---|---|---|---|---|---|---|---|---|---|---|---|---|
| P$_6$ | P$_4$ | P$_3$ | P$_2$ | P$_1$ | P$_1$' | | $k_{cat}$ | $K_m$ | $k_{cat}/K_m$ | $k_{cat}$ | $K_m$ | $k_{cat}/K_m$ | $(k_{cat}/K_m)$B |
| | | | | | | mM | s$^{-1}$ | mM | M$^{-1}$ s$^{-1}$ | s$^{-1}$ | mM | M$^{-1}$ s$^{-1}$ | |
| | | | Z-Ala | Arg | SBu-i | 0.02-0.09 | | NH$^a$ | | 0.17 | 0.13 | 1290 | |
| | | | Z-Gly | Arg | SBu-i | 0.10-0.30 | | NH | | | | 320 | |
| | | | Z-Lys | Arg | SBu-i | 0.54 | | SH$^b$ | | | SH$^b$ | | |
| | | | Z-Lys | Arg | SBzl | 0.06-0.43 | 1.62 | 1.19 | 1370 | 1.36 | 0.58 | 2320 | 1.7 |
| | | MeO-Suc | Lys | Arg | SBzl | 0.04-0.21 | 0.37 | 0.48 | 770 | 0.28 | 0.16 | 1800 | 2.3 |
| | Z-Leu | Ala | Arg | SBzl | | 0.03-0.18 | | | 240 | 0.57 | 0.11 | 5360 | 22.3 |
| | Z-Gly | Leu-Ala | Arg | SBzl | | 0.03-0.12 | | | 710 | 0.59 | 0.06 | 9220 | 13.0 |
| Z-Leu-Gly | Leu | Ala | Arg | SBzl | | 0.02-0.18 | | NH | | | | 1100 | |
| | | | Z-Gln | Arg | SBzl | 0.19 | | NH | | | SH$^b$ | | |
| | | Z-Leu | Gln | Arg | SBzl | 0.14 | | NH | | | SH$^b$ | | |
| | Z-Gly | Leu-Gln | Arg | SBzl | | 0.30 | | NH | | | SH$^b$ | | |
| | | Z-Leu | Gly | Arg | SBzl | 0.10-0.21 | | | 810 | 0.49 | 0.38 | 1300 | 1.6 |
| | Z-Gln | Leu-Gly | Arg | SBzl | | 0.10-0.22 | | | 810 | | | 970 | 1.2 |
| Z-Met-Gln | Leu | Gly | Arg | SBzl | | 0.08-0.18 | 0.31 | 3.0 | 104 | 0.12 | 0.21 | 560 | 5.4 |

$^a$ NH, no hydrolysis.
$^b$ Slow hydrolysis was detected, but no kinetic constants could be obtained due to insufficient substrate.

FIG. 4C

TABLE IV

*Kinetic constants for the hydrolysis of synthetic thioester substrates by bovine trypsin*

0.1 M Hepes buffer at pH 7.5, 10 mM CaCl$_2$, 9.8% Me$_2$SO at 25 °C, 1.55 ~ 2.74 nM trypsin.

| Substrate | | | | | | Substrate concentration | $k_{cat}$ | $K_m$ | $k_{cat}/K_m$ |
|---|---|---|---|---|---|---|---|---|---|
| P$_5$ | P$_4$ | P$_3$ | P$_2$ | P$_1$ | P$_1$' | | | | |
| | | | | | | μM | s$^{-1}$ | μM | M$^{-1}$ s$^{-1}$ |
| | | | | Z-Arg | SBzl | 16.6-83.2 | 210 | 53 | 3,900,000 |
| | | | Z-Lys | Arg | SBzl | 20.3-81.4 | 56 | 8.2 | 6,800,000 |
| | | | Z-Lys | Arg | SBu-i | 2.3-51.3 | 18 | 7.1 | 2,500,000$^a$ |
| | | | Z-Arg | Arg | SBzl | 13.9-69.4 | 48 | 7.0 | 6,900,000 |
| | | | Z-Gln | Lys | SBzl | 5.8-29.1 | 150 | 38 | 3,900,000 |
| | | | Z-Gln | Arg | SBzl | 12.3-61.5 | 54 | 10 | 5,200,000 |
| | | | Suc | Arg | SBzl | 8.9-44.6 | 145 | 78 | 1,900,000 |
| | | | Z-Aba | Arg | SBzl | 10.9-54.7 | 79 | 10 | 7,700,000 |
| | | | Aba | Arg | SBzl | 15.3-76.7 | 61 | 7.9 | 7,800,000 |
| | | | Suc-Lys | Arg | SBzl | 3.6-22.0 | 72 | 10 | 7,100,000 |
| | | | MeO-Suc-Lys | Arg | SBzl | 15.4-76.8 | 69 | 12 | 5,700,000 |
| | | | Ac-Lys | Arg | SBzl | 14.1-70.7 | 100 | 15 | 6,800,000 |
| | | | Bz-Lys | Arg | SBzl | 10.4-51.8 | 28 | 6.6 | 4,200,000 |
| | | Bz-Gln | Lys | Arg | SBzl | 8.2-41.1 | 30 | 8.2 | 3,700,000 |
| | | Bz-Gly | Lys | Arg | SBzl | 7.9-39.7 | 15 | 1.9 | 7,800,000 |
| | | Bz-Phe | Lys | Arg | SBzl | 6.3-31.5 | 38 | 8.1 | 4,800,000 |
| | | Bz-Glu | Lys | Arg | SBzl | 8.3-41.3 | 31 | 11 | 2,900,000 |
| | Bz-Gln-Gln | Lys | Arg | SBzl | | 12.2-60.8 | 34 | 21 | 1,600,000 |
| | | Suc-Phe | Arg | SBzl | | 2.2-5.6 | 6.4 | 3.3 | 2,000,000 |
| | | Z-Phe | Arg | SBzl | | 8.3-41.4 | 64 | 19 | 3,400,000 |
| | | Z-Gln-Phe | Arg | SBzl | | 11.2-56.2 | 37 | 7.6 | 4,900,000 |
| | | Z-Glu-Phe | Arg | SBzl | | 5.0-19.8 | 27 | 6.8 | 4,000,000 |
| | Boc-Val-Phe | Arg | SBzl | | | 5.6-56.1 | 55 | 12 | 4,600,000$^a$ |

$^a$ McRae et al., 1981a.

FIG. 4D

TABLE V

*Sites of cleavage of complement proteins by protein D and enzyme complexes of C2 and Bb*

| Enzyme complex | Sequence | | | | | | | | | Substrate | Reference |
|---|---|---|---|---|---|---|---|---|---|---|---|
| | P$_5$ | P$_4$ | P$_3$ | P$_2$ | P$_1$ | P$_1$' | P$_2$' | P$_3$' | P$_4$' | | |
| C4b2a C3bBb | -Leu | -Gly | -Leu | -Ala | -Arg | -Ser | -Asn | -Leu | -Asp- | C3 | Hugli, 1975; Tack et al., 1979 |
| C4b2a3b C(3b)$_n$Bb | -Met | -Gln | -Leu | -Gly | -Arg | -Leu | -His | -Met | -Lys- | C5 | Fernandez and Hugli, 1978; DiScipio et al., 1983 |
| D | -Glu | -Gln | -Gln | -Lys | -Arg | -Lys | -Ile | -Val | -Leu | B | Mole et al., 1984 |

FIG. 4E

Table VII

Thioester Substrates which were not hydrolyzed by fragments C2a, and Bb.

0.1 M HEPES buffer at pH 7.5, 0.5 M NaCl and 9.8% DMSO, 25°C. Enzyme concentrations: 14nM C2a and 20 nM Bb.

| substrate | substrate concentration |
|---|---|
| | mM |
| RCO-Arg-SBzl | RCO = Aba(0.21), Z-Aba(0.15), and Suc(0.12) |
| RCO-Lys-Arg-SBzl | RCO = Ac(0.19), Suc(0.03), and Bz(0.14) |
| Suc-Phe-Arg-SBzl | 0.0015 |
| Z-Val-Arg-SBu-i | 0.252 |
| Z-AA-Phe-Arg-SBzl | AA = Glu(0.053), Gln(0.151) |
| Z-Gln-Lys-Arg-SBzl | 0.078 |
| Bz-AA-Lys-Arg-SBzl | AA = Gln(0.11), Gly(0.11), Glu(0.11), and Phe(0.085) |
| Boc-Val-Phe-Arg-SBzl | 0.20 |
| Z-Gln-Arg-Arg-SBzl | 0.165 |
| Bz-Gln-Gln-Lys-Arg-SBzl | 0.163 |
| Z-Met-Gly-Leu-Gln-Arg-SBzl | 0.057 |

FIG. 4F

IMAGING REPORTERS OF TRANSGENE EXPRESSION

CROSS-REFERENCES TO RELATED APPLICATIONS

This application is a U.S. National Phase application of PCT Patent Application No. PCT/US2005/033073, filed Sep. 16, 2005, and claims priority under 35 U.S.C. §119(e) to U.S. Provisional Patent Application No. 60/610,681, filed Sep. 17, 2004, each of the above-referenced patent applications are hereby incorporated by their entirety for all purposes.

BACKGROUND

Previous imaging technologies relied mostly on nonspecific macroscopic physical, physiological, or metabolic changes that differentiate pathological from normal tissue rather than identifying specific molecular events (e.g., gene expression) responsible for disease. Molecular imaging, however, exploits specific molecular probes as the source of image contrast. This change in emphasis from a nonspecific to a specific approach represents a significant paradigm shift, the impact of which is that imaging can now provide the potential for understanding of integrative biology, earlier detection and characterization of disease, and evaluation of treatment (Massoud 2003).

The emergence of molecular imaging strategies is largely due to advances in molecular and cell biology techniques, the use of transgenic animal models, availability of newer imaging drugs and probes that are highly specific, and successful development of small-animal imaging instrumentation. These factors, along with continued expansion of scientific horizons in the current postgenomic era, have been pivotal in the drive toward a new standard that allows linking established in vitro and cell culture experimental assays to imaging studies within living subjects.

Molecular imaging creates the possibility of achieving several important goals in biomedical research, namely, (1) to develop noninvasive in vivo imaging methods that reflect specific cellular and molecular processes, for example, gene expression, or more complex molecular interactions such as protein-protein interactions; (2) to monitor multiple molecular events near-simultaneously; (3) to follow trafficking and targeting of cells; (4) to optimize drug and gene therapy; (5) to image drug effects at a molecular and cellular level; (6) to assess disease progression at a molecular pathological level; and (7) to create the possibility of achieving all of the above goals of imaging in a rapid, reproducible, and quantitative manner, so as to be able to monitor time-dependent experimental, developmental, environmental, and therapeutic influences on gene products in the same animal or patient (Massoud 2003).

What is needed in the art is an imaging reporter using an extracellular, membrane bound protein for docking with a tagged particle.

SUMMARY

Disclosed are methods and compositions related to imaging transgene expression.

BRIEF DESCRIPTION OF THE DRAWINGS

The accompanying drawings, which are incorporated in and constitute a part of this specification, illustrate several embodiments and together with the description illustrate the disclosed compositions and methods.

FIG. 3 shows cleavage sites which can be used as hinge regions. The references referred to in the last column by numbers 98-120 are as follows: 98. Blomback G: The N terminal disulfide knot of human fibrinogen. Br J Haematol 17:145, 1969; 99. Iwanaga S, Wallen P, Grandahl N Y et al: On the primary structure of human fibrinogen, isolation and characterization of N terminal fragments from plasmic digests. Eur J Biochem 8:189, 1964; 100. Takagi T, Doolittle R F: Amino acid sequence studies on Factor XIII and the peptide released during its activation by thrombin. Biochemistry 13:750, 1974; 101. Eaton D, Rodriguez H, Vehar G A: Proteolytic processing of human Factor VIII. Biochemistry 25:505, 1986; 102. Mann K G, Jenny R J, Krishnaswamy S: Cofactor proteins in the assembly and expression of blood clotting enzyme complexes. Ann Rev Biochem 57:915, 1988; 103. Hagen F S, Gray C L, O'Hara P et al: Characterization of a cDNA coding for human Factor VII. Proc Natl Acad Sci USA 83:2412, 1986; 104. Radcliffe R, Nemersen Y: Bovine Factor VII. Methods Enzymol 45:49, 1976; 105. Elion J, Butkowski R J, Downing M R, Mann K G: Primary structure of human fragment 2. Circulation 54:118, 1976; 106. Walz D A, Hewett-Emmett D, Seegers W H: Amino acid sequence of human prothrombin fragment 1 and 2. Proc Natl Acad Sci USA 74:1963, 1977; 107. Downing M R, Butkowski R J, Clark M M, Mann K G: Human prothrombin activation. J Biol Chem 250:8897, 1975; 108 Heldebrant C M, Noyes C, Kingdon H S, Mann K G: The activation of prothrombin III. Biochem Biophys Res Comm 54:155, 1973; 109 Magnusson S, Petersen T E, Sottrup-Jensen L, Claeys H: Complete primary structure of prothrombin. In Reich, Rifkin, Shaw (eds): Proteases and Biological Control. Cold Spring Harbor, N.Y., Cold Spring Harbor Laboratory, 1975; 110 D, Davie E W: Characterization of a cDNA coding for human protein C. Proc Natl Acad Sci USA 81:4766, 1984; 111 Long G L, Belagaje R M, MacGillivray R T A: Cloning and sequencing of liver cDNA coding for bovine protein C. Proc Natl Acad Sci USA, 1984; 112 Mutt V, Magnusson S, Jorpes J E, Dahi E: Structure of procine secretin. Biochemistry 4:2358, 1965; 113 Morgan R J, Birken S, Canfield R E: The amino acid sequence of human chorionic gonadotropin, J Biol Chem 250:5247, 1975; 114 Engel A, Alexander B: Activation of chymotrypsinogen A by thrombin preparations. Biochemistry 3:3590, 1966; 115 Luncblad R I, Kingdon H S, Mann K G: Thrombin. Methods Enzymol 45:156, 1976; 116 Mutt V, Jorpes J E: Structure of procine cholecystorinin pancreozymin. Eur J Biochem 6:156, 1968; 117 Graf L, Barat E, Borvendeg J et al: Action of thrombin on ovine, bovine and human pituitary growth hormones. Eur J Biochem 64:333, 1976; 118 Muzbek L, Gladner J A, Lali K: The fragmentation of actin by thrombin. Arch Biochem Biophys 167:99, 1975; 119 Sparrow J T, Pownall H J, Hsu F et al: Lipid binding by fragment of apolipoprotein C-III-1 obtained by thrombin cleavage. Biochemistry 16:5427, 1977; 120 Leavis P C, Rosenfeld S, Lu R C: Cleavage of a specific bond in troponin C by thrombin. Biochim Biophys Acta 535:281, 1978; 121 Vu T K H, Hung D T, Wheaton V I, Coughlin S R: Molecular cloning of a functional thrombin receptor reveals a novel proteolytic mechanism of receptor activation. Cell 64:1057, 1991 all of which are herein incorporated by reference at least for material related to cleavable sequences.

FIG. 4 shows cleavage sites which can be used as hinge regions. These were used from Kam et al., "Human Complement Proteins D, C2, and B," J. Biol. Chem. 262(8):3444-3451 (1987) which is herein incorporated by reference at least for material related to cleavage sites.

DETAILED DESCRIPTION

Figure 1:
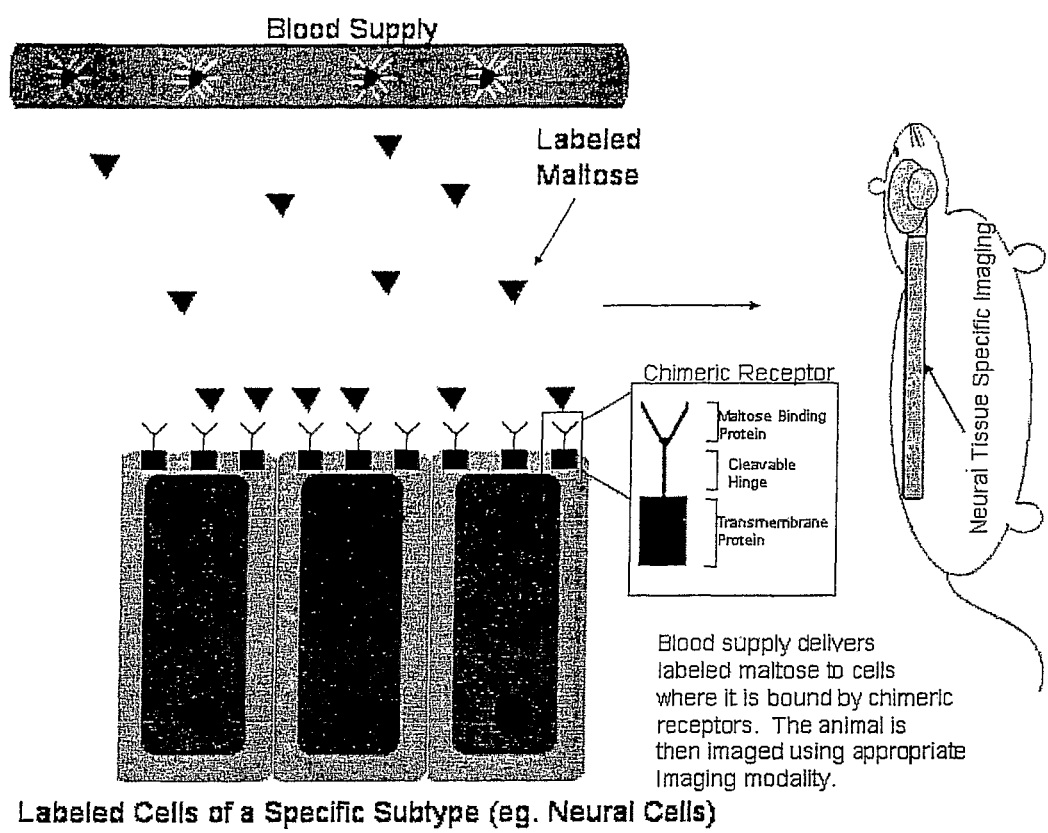
FIG. 1 shows a diagram of the application of this technology in imaging neural tissue. In this example receptor transcription is induced specifically in the central nervous system. This receptor is composed of a transmembrane domain, a cleavable hinge and maltose binding protein. Maltose binding protein is expressed in the extracellular space. Maltose is labeled with a molecule specific to the desired imaging modality and is administered intravenously to the mouse. The mouse is subsequently imaged using this modality, and the tissues (neural in this example) where the receptor is expressed are visualized.

Before the present compounds, compositions, articles, devices, and/or methods are disclosed and described, it is to be understood that they are not limited to specific synthetic methods or specific recombinant biotechnology methods unless otherwise specified, or to particular reagents unless otherwise specified, as such may, of course, vary. It is also to be understood that the terminology used herein is for the purpose of describing particular embodiments only and is not intended to be limiting.

A. Definitions

As used in the specification and the appended claims, the singular forms "a," "an" and "the" include plural referents unless the context clearly dictates otherwise. Thus, for example, reference to "a pharmaceutical carrier" includes mixtures of two or more such carriers, and the like.

Ranges can be expressed herein as from "about" one particular value, and/or to "about" another particular value. When such a range is expressed, another embodiment includes from the one particular value and/or to the other particular value. Similarly, when values are expressed as approximations, by use of the antecedent "about," it will be understood that the particular value forms another embodiment. It will be further understood that the endpoints of each of the ranges are significant both in relation to the other endpoint, and independently of the other endpoint. It is also understood that there are a number of values disclosed herein, and that each value is also herein disclosed as "about" that particular value in addition to the value itself. For example, if the value "10" is disclosed, then "about 10" is also disclosed. It is also understood that when a value is disclosed that "less than or equal to" the value, "greater than or equal to the value" and possible ranges between values are also disclosed, as appropriately understood by the skilled artisan. For example, if the value "10" is disclosed the "less than or equal to 10" as well as "greater than or equal to 10" is also disclosed. It is also understood that throughout the application, data is provided in a number of different formats, and that this data, represents endpoints and starting points, and ranges for any combination of the data points. For example, if a particular data point "10" and a particular data point 15 are disclosed, it is understood that greater than, greater than or equal to, less than, less than or equal to, and equal to 10 and 15 are considered disclosed as well as between 10 and 15.

In this specification and in the claims which follow, reference will be made to a number of terms which shall be defined to have the following meanings:

"Optional" or "optionally" means that the subsequently described event or circumstance may or may not occur, and that the description includes instances where said event or circumstance occurs and instances where it does not.

"Primers" are a subset of probes which are capable of supporting some type of enzymatic manipulation and which can hybridize with a target nucleic acid such that the enzymatic manipulation can occur. A primer can be made from any combination of nucleotides or nucleotide derivatives or analogs available in the art, which do not interfere with the enzymatic manipulation.

"Probes" are molecules capable of interacting with a target nucleic acid, typically in a sequence specific manner, for example through hybridization. The hybridization of nucleic acids is well understood in the art and discussed herein. Typically a probe can be made from any combination of nucleotides or nucleotide derivatives or analogs available in the art.

The terms "higher," "increases," "elevates," or "elevation" refer to increases above basal levels, e.g., as compared to a control or basal level. The terms "low," "lower," "reduces," or "reduction" refer to decreases below basal levels, e.g., as compared to a control or basal level.

By "label" is meant any detectable tag that can be attached directly (e.g., a fluorescent molecule integrated into a polypeptide or nucleic acid) or indirectly (e.g., by way of activation or binding to an expressed genetic reporter, including activatable substrates, peptides, receptor fusion proteins, primary antibody, or a secondary antibody with an integrated tag) to the molecule of interest. A "label" is any tag that can be visualized with imaging methods. The detectable tag can be a radio-opaque substance, radiolabel, a fluorescent label, a light emitting protein or substrate, a magnetic label, or microbubbles (air filled bubbles of uniform size that remain in the circulatory system and are detectable by ultrasonography, as described in Ellega et al. Circulation, 108:336-341, 2003, which is herein incorporated in its entirety). The detectable tag can be, for example, gamma-emitters, beta-emitters, and alpha-emitters, positron-emitters, X-ray-emitters, ultrasound reflectors (microbubbles), and fluorescence-emitters suitable for localization. Suitable fluorescent compounds include fluorescein sodium, fluorescein isothiocyanate, phycoerythrin, Green Fluorescent Protein (GFP), Red Fluorescent Protein (RFP), Texas Red sulfonyl chloride (de Belder & Wik, Carbohydr. Res. 44(2):251-57 (1975)), as well as compounds that are fluorescent in the near infrared such as Cy5.5, Cy7, and others. Also included are genetic reporters detectable following administration of radiotracers such as hSSTr2, thymidine kinase (from herpes virus, human mitochondria, or other) and NIS (iodide symporter). Light emitting proteins include various types of luciferase.

"Operably linked" is defined as the expression of a nucleic acid under the control of a given promoter sequence; i.e., the promoter controls the expression of a given nucleic acid. The given nucleic acid can be, but is not limited to, a reporter nucleic acid.

The term "promoter" is defined as a DNA regulatory region capable of binding RNA polymerase in a cell and initiating transcription of a downstream (3' direction) coding sequence.

As used throughout, by a "subject" is meant an individual. Thus, the "subject" can include domesticated animals, such as cats, dogs, etc., livestock (e.g., cattle, horses, pigs, sheep, goats, etc.), laboratory animals (e.g., mouse, rabbit, rat, guinea pig, etc.) and birds. Preferably, the subject is a mammal such as a primate, and, more preferably, a human.

Throughout this application, various publications are referenced. The disclosures of these publications in their entireties are hereby incorporated by reference into this application in order to more fully describe the state of the art to which this pertains. The references disclosed are also individually and specifically incorporated by reference herein for the material contained in them that is discussed in the sentence in which the reference is relied upon.

B. Methods

1. General

Molecular imaging is important in the evaluation of therapeutic approaches for genetic diseases. Molecular imaging offers advantages for the evaluation of new molecular therapies, including gene therapy. Imaging can confirm in vivo targeting or it can be used to monitor molecular responses induced by therapy. For gene therapy approaches, the extent and magnitude of both gene transfer and expression can be determined by molecular imaging. Furthermore, real time imaging of gene expression in vivo allows for the monitoring expression of a gene using non-invasive means.

Disclosed herein are cross-platform in vivo imaging reporters using a transgene-derived extracellular, membrane-bound protein in the form of a genetic construct. This genetic construct is delivered to cells or tissues, and expression of the reporter is detected by in vivo imaging; the intensity of imaging signal being related to the amount of reporter being expressed. This membrane bound protein can be either a receptor or an antigen, and can be used for docking with a ligand (tagged particle). Such a ligand can include antibodies, proteins, peptides, carbohydrates, chemical compounds, polysaccharides, lipids, or lipid macromolecules (e.g. liposomes). The extracellular, membrane-bound protein can be composed of a transmembrane domain, a cleavable hinge, for example a Complement or Factor IX cleavage site, and a ligand or antibody binding protein, such as maltose binding protein, avidin, glutathione-S-transferase (GST), or cd-44, for example.

Applications of this system include, but are not limited to, studying mouse disease models such as cancer (tumor imaging, tracking and treatment), other non-tumor disease models such as Alzheimer's and Prions diseases (monitoring the state of neural tissue), basic in vivo physiology in mice (e.g. monitoring the presence/health and gene expression of any interesting subset of cells, such as dopaminergic neurons), or for clinical application such as monitoring transplanted cells (e.g., hematopoetic/pancreatic/brain stem cells and specialized cells (e.g., islet cells) into human patients) as well as monitoring tissue growth and regeneration (such as in studies related to paralysis) (FIG. 1.)

This technology has the following advantages: Previously, the best reporter technologies were capable of visualizing gene expression in only three different modalities using a tri-fusion protein (Ray et al). No technology at this time can control the pharmacokinetics of the substrate. The methods and compositions disclosed herein offer the ability to perform real-time and steady state reporting in at least five different modalities while at the same time offering the ability to control the pharmacokinetics of the substrates utilized.

2. Targeted Modification of Cells

The chimeric receptor can also be used for targeted modification of cells marked by the receptor. The specificity of the ligand-receptor interaction can be used to bring liposomes and other transmembrane delivery vehicles including transmembrane targeting peptides, such as HIV Tat protein, closer to the cell membrane of specific cells, thereby accelerating cellular uptake.

a) Targeted Ablation or Gene Expression Activation in Specific Cells

By labeling the ligand with a molecule which is excited by a specific radiofrequency (e.g. ultrasound) or a specific frequency of electromagnetic radiation (e.g. microwaves or x-rays) it is possible to ablate cells. This can be used in therapies in which cells bearing the chimeric receptor are transplanted into patients and subsequently become harmful (e.g. cancerous) or studies in which cell or tissue specific targeted ablation may be desired (e.g. tumors, diseased tissues etc.). This technology can also be used to activate engineered, heat-shock genes by using a lower dose of radiofrequency/radiation. By labeling the ligand with a molecule which is excited by a specific radiofrequency or specific frequency of electromagnetic radiation and using a lower dose of radiation (shorter time and/or intensity), instead of killing the cells the temperature can be raised sufficiently to activate heat shock genes.

For example, these same receptors can also be used to target cells for one or two step destruction. The single step destruction can be accomplished by ligand-mediated delivery of any toxin or anticellular agent, such as diphtheria toxin, dnase or barnase (Nucleic Acids Res. 2001 Aug. 15; 29(16): E76) In the two step destruction can be mediated by delivery of an iron oxide particle to the cell surface that with exposure to radiofrequency or microwave radiation leads to iron oxide particle vibration and heat-mediated destruction of the tagged cells, for example delivery of thymidine kinase, which upon internalization leads to cell death in the presence of administered gancyclovir.

Disclosed are methods of visualizing a cell in an animal or human comprising, a) oral, intraperitoneal, intravenous, or intrathecal administration of a binding domain ligand into the animal, wherein the binding domain ligand comprises a label, and wherein the cell comprises a visualization molecule, wherein the visualization molecule comprises a transmembrane domain and an extracellular binding domain, wherein the binding domain ligand interacts with the binding domain, and b) visualizing the label of the binding domain ligand.

Also disclosed are methods, wherein the visualization molecule further comprises a secretory or plasma membrane trafficking signal domain. Virtually any transmembrane protein has secretory or transmembrane targeting sequence. Ig-k is an example of a protein with a secretory leader sequence. HLA-B7, PDGFR, EGFR, and IGFR are examples of proteins with a transmembrane targeting sequence.

Also disclosed are methods, wherein the visualization molecule further comprises a hinge domain recognized by an endogenous protease, or wherein the visualization molecule further comprises a cleavable hinge domain.

Also disclosed are methods, wherein the visualization of the label allows a pharmokinetic steady state most dependent on the rate of degradation. Thus acting as a steady-state marker of cell health or rapidly allowing real time reporting based on transcriptional and translational rates (thus acting as a molecular reporter of the promoter which drives visualization molecule, and that reporter could be specifically activated only by certain signally pathway(s) of interest, say a pathway known to be affected by a certain class of drugs. By using a slowly cleaving hinge or not using a hinge at all, one can visualize the cells in their steady-state because one only visualizes the ligand bound to its receptor. By using a fast cleaving hinge the visualization of the ligand is dependent on the rate at which the receptor is being created and thus one can perform real-time imaging to track the rate of the promoter which is essentially driving the production of the receptor. Using no hinge essentially provides no clearance of the receptor and is used for steady-state imaging while using a hinge which is cleaved quickly such as factor IX, one can visualize in real-time the production of the receptor.

Also disclosed are methods, wherein the hinge region is between the transmembrane domain and the binding domain, wherein the hinge allows for the control of the pharmacokinetic rate at which the bound binding domain ligand is cleared, or wherein the hinge domain comprises a Complement site or a Factor IX site.

Also disclosed are methods, wherein the transmembrane domain comprises a single-pass or multi-pass transmembrane domain. Some examples of single pass transmembrane domains are the receptor tyrosine kinases, e.g. epidermal growth factor receptor (EGFR) or platelet derived growth factor receptor (PDGFR).

Also disclosed are methods, wherein the binding domain comprises the maltose binding protein, avidin, streptavidin, glutathione-S-transferase (GST), or cd-44, wherein the binding domain ligand comprises maltose or its derivatives, biotin, glutathione, or a hyaluran polymer, wherein the label comprises a fluorescent probe such as cy5.5 or fitc, iodine or any other dense metal, a stable isotope, or gadolidium, wherein the visualization molecule further comprises multiple binding domains, wherein the visualization molecule further comprises an identification domain, wherein the identification domain comprises an epitope, wherein the epitope comprises a hemagglutinin A epitope, a FLAG tag, or a myc epitope, further comprising a second identification domain, wherein the visualization of the label comprises performing non-invasive imaging, computed tomography, bioluminescence imaging, planar gamma camera imaging, single photon three-dimensional (3-D) emission computed tomography (SPECT) imaging, continuous-wavelength or time-domain light-based imaging, magnetic resonance imaging, fluorescence imaging, diffuse optical tomography, ultrasonography, Positron Emission Topography (PET) imaging, fluorescence correlation spectroscopy, in vivo two-photon microscopy, optical coherence tomography, speckle microscopy, nanocrystal labeling, or second harmonic imaging, wherein the animal is an animal capable of being used as a disease model, wherein the disease is hamartoma or neoplasia, degenerative or neuro-degenerative, auto-immune, or an infectious disease, wherein the visualization of the label identifies a tumor, wherein the visualization label allows for monitoring of a treatment of a disease, wherein the visualization method allows for monitoring of a transplanted cell or a transfected diseased or non-diseased cell, wherein the transplanted pluripotent, multipotent, or monopotent stem cell or differentiated cell comprises a hematopoietic cell, a mesenchymal cell such as a muscle cell, a pancreatic cell, or a neural cell, wherein the visualization molecule is present in a subset of cells of the animal, wherein the visualization molecule occurs in a specific tissue such as a preneoplastic cell, neoplastic cell or a normal endodermal, ectodermal, or mesenchymal cell, wherein the visualization molecule is induced to occur in the cell, wherein the visualization molecule occurs in the cell constitutively.

Disclosed are methods producing an animal comprising transfecting the animal or human cell or diseased tissue with a genetic construct encoding a visualization molecule.

Disclosed are methods of producing a cell comprising transfecting the cell with a genetic construct encoding a visualization molecule.

Disclosed are cells comprising a visualization molecule.

Also disclosed are animals comprising a visualization molecule.

Also disclosed are animals wherein the expression of the visualization molecule is controlled by a recombinase, wherein the recombinase is Cre.

Also disclosed are methods of visualizing a cell comprising, a) transfecting the cell with a visualization construct, wherein the visualization construct comprises a sequence encoding a transmembrane region and a binding domain, b) injecting a binding domain ligand, wherein the binding domain ligand comprises a label, and c) visualizing the label of the binding domain ligand.

Also disclosed are methods where the effect of various compounds on a disease, or state of a cell or animal are monitored by using the disclosed compositions and methods. Compostions can also be screened for activity and the disclosed methods and compositions can be used to monitor or identify compounds having a desired effect on the cells or animal.

Also disclosed are systems by which a human patient with a diseased or normal tissue undergoes a surgical or interventional radiology procedure transfecting the diseased or normal target tissue with the visualization molecule whose expression is controlled by an exogenous reporter that is responsive to a signaling pathway important to the action of a class of drugs. By visualizing in real time the efficacy of that drug in the diseased or target tissue, one would immediately have a surrogate measure of the patient's response to a potential therapy or treatment.

3. Imaging and Cancer

Understanding the molecular mechanisms involved in different types of cancer is key in identifying and targeting various steps in cancer progression for therapeutic intervention. Once these mechanisms have been elucidated, therapeutic treatments can be monitored for efficacy as related to these specific mechanisms and signal transduction pathways. Sophisticated mouse models can be generated to overcome this problem. What is needed is a tool for monitoring micro-invasion and micrometastasis. The disclosed methods include an in-vivo, multi-modality reporter that allows for early detection of cancer progression in mouse cancer models, and consequent monitoring of therapeutic treatment efficacy in these models.

Figure 5:
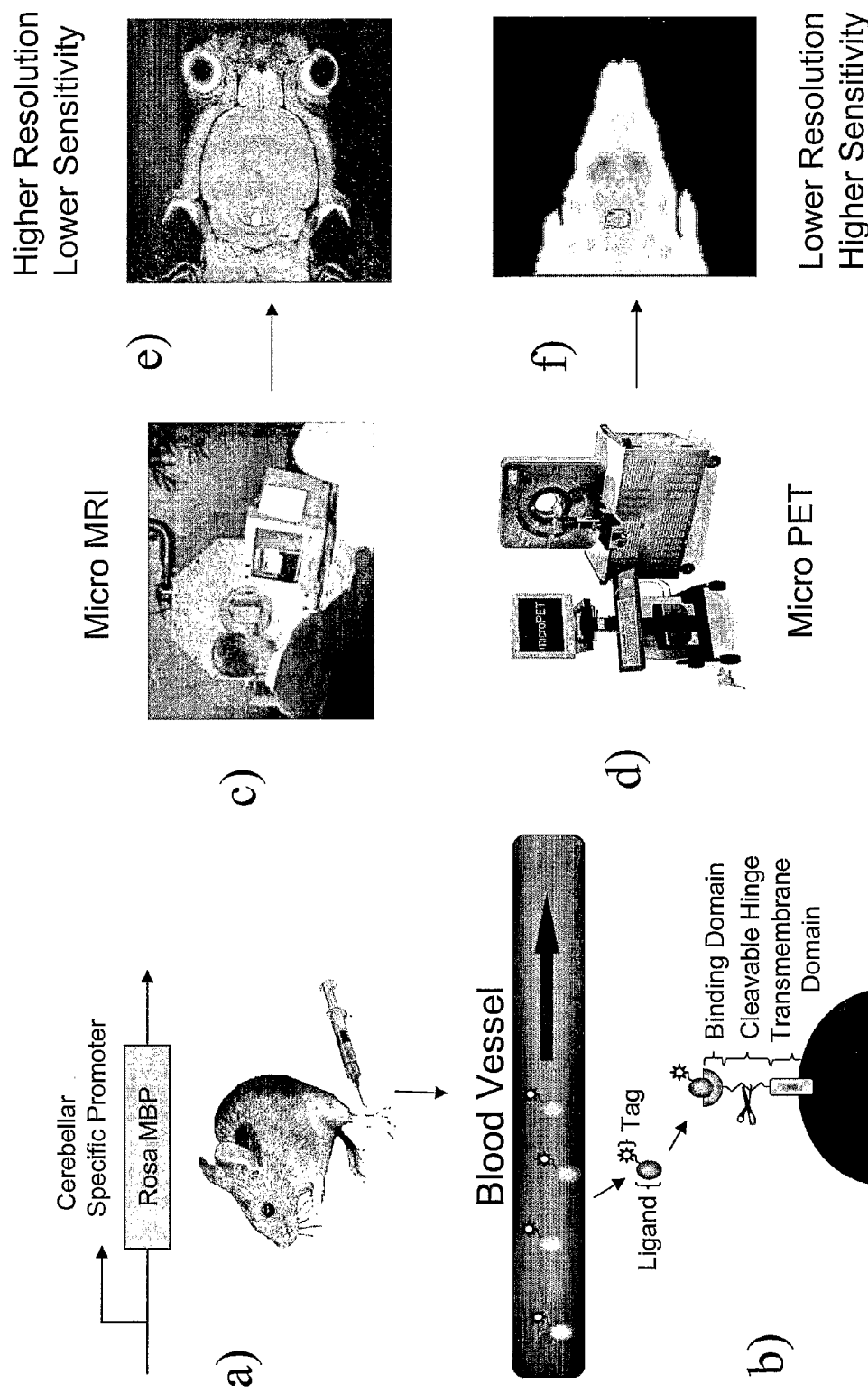
FIG. 5 shows the binding domain (MBP) is expressed in the mouse cerebellum. Modality specific contrast agent bound to the ligand (maltose) is injected into the mouse blood stream (a). The contrast bound ligand diffuses into the extracellular space where it binds the binding domain (b). The mouse is then imaged using the modality appropriate to the contrast agent (c&d) and the cerebellum is enhanced (e&f).

Mice are created that can conditionally express a chimeric receptor on cancer cells (FIG. 5) that facilitates imaging across multiple modalities (e.g. CT/MRI/PET/Optical). This chimeric receptor is composed of a single pass transmembrane domain and an extracellular maltose-binding domain. Activation of this reporter in pre-malignant cells allows for early detection of proliferation, micro-invasion and micrometastasis. The chimeric receptor's ligand, maltose, can be labeled with a variety of different substrates such as gadolidium, iodine, radiolabeled substrates, a red fluorescent protein or cy5.5. These differently labeled maltose probes are then intravenously injected into the genetically engineered mice. The labeled maltose then binds the tumor cell-specific chimeric receptors. Consequently, this binding activity allows for real-time multi-modality in vivo imaging using MRI, CT, PET, fluorescent or optical imaging (depending on the label bound to the maltose injected).

The use of steady-state tumor cell reporting (visualization of specific gene expression) in vivo using anatomically high resolution (CT/MRI) and molecularly sensitive (PET/Optical) imaging has been a much sought after technology. Currently, the best available technologies are limited to three different non-high resolution modalities (PET/Luminescent/Fluorescent) using a tri-fusion protein. Through the use of a labeled ligand, temporal control of contrast-enhanced multi-modal imaging can be achieved. This offers greater flexibility, allowing for visualization of cell populations in living transgenic animals through a minimally invasive means. When these tools are extended to study the steady-state of tissues, the health of specific tissues in animal models of diseases can be monitored.

This technology facilitates an in-depth study of the molecular mechanisms involved in tumorigenesis and cancer progression (e.g. metastasis). Knowledge gained through the application of this technology to monitor drug efficacy leads to better treatment, resulting in the inhibition of cancer progression and ultimately cancer regression. This technology can also be applied in a variety of other applications including real-time in vivo gene expression analysis for physiologic and disease models.

4. Imaging Reporters

Imaging reporters are molecules that are capable of allowing the visualization of a tissue or cell in vivo. Imaging reporters can be used in any of the methods disclosed herein, for example. Visualization means that the imaging reporter itself can be identified through for example, fluorescence or radiolabeling and because the imaging reporter is associated with a particular cell or tissue it therefore allows the cell or tissue to be identified or visualized. Imaging reporters are typically made up of a transmembrane domain and a binding domain, as discussed herein. Often an imaging reporter will also have a cleavable hinge domain. An imaging reporter can have, however, many other parts, including reporter binding sites, antibody recognition sites, specific cellular trafficking signals, or domains that can be used for purification, for example.

a) Transmembrane Domains

Any transmembrane region or sequence can be used. Examples of transmembrane domains include the transmembrane of tyrosine kinase receptors, single-pass transmembrane domains such as the tyrosine family (epidermal growth factor receptor (EGFR) and platelet-derived growth factor receptor (PDGFR)), g-protein receptor, multi-pass transmembrane domains, such as the transmembrane domains of G-proteins, or other such transmembrane domains. For example, the regions in Table 7 contain transmembrane domains.

TABLE 7

Region spliced of transmemebrane domain proteins

| Protein | Amino Acid Start | Amino Acid End | NCBI Reference Number |
|---|---|---|---|
| EGFR | 648 (SEQ ID NO: 67) | 669 (SEQ ID NO: 67) | Mm.8534 |
| PDGFR | 527 (SEQ ID NO: 69) | 556 (SEQ ID NO: 69) | Mm.4146 |
| GHR | 266 | 289 | NP058790 |
| IGFR | 935 | 959 | NP434694 | b) Binding Domains

Any binding domain can be used. The binding domain allows for binding of substrates such as maltose (to be used in conjunction with maltose binding protein), biotin (to be used with avidin), glutathione (to be used with GST), or hyaluran polymers (which can be any length and can be used to recognize cd-44 or RHAMM protein, Nat Rev Cancer. 2004 July; 4(7):528-39), for example. These substrates can be individually labeled with a variety of imaging tags, which would be any molecule capable of being identified, such as by fluorescence or radiography, or any other way, including cy5.5 for non-invasive animal imaging, such as small animals, iodine for animal computed tomography, such as small animals, a stable isotope for SPECT or PET imaging, or gadolidium for magnetic resonance imaging, for example. Detection of signal can be significantly enhanced by designing single substrates bound with multiple tags.

(1) Classes of Binding Proteins

Thus, one class of binding domains are those where the substrate for the binding domain is not present in the animal, such as a mammal. Another class of binding domains are those in which the substrate may be present but it is not ubiquitously present, for example, being present in only 1, 2, 3, 4, 5, 6, 7, 8, 9, 10, 11, 12, 13, 14, or 15 different tissues or cell types for example. Other classes of binding domains which can be used in any combination with others discussed herein, would be binding domains which bind a substrate which is not toxic to the animal, or binding domains binding substrates which maybe toxic while present in the animal, but when cleared from the animal, are no longer harmful, or those binding domains binding substrates which may be toxic but do not cause death to the animal.

(2) Maltose Binding Protein

Maltose binding protein (SEQ ID NO:15) is one type of useful binding domain because its ligand, maltose, is not present except in the gastrointestinal lumen of mammals, and its natural ligands are bound specifically but are not toxic in mammals. Maltose binding protein is a periplasmic bacterial protein encoded by a 1.2 kb gene. It is known to bind several substrates including linear maltodextrins of two to at least seven alpha 1,4 linked glucosyl units, for example, maltose, maltotriose, and maltohexose, as well as cyclic maltodextrins such as cyclomaltohexose and cyclomaltoheptaose, for example, with high affinities ($K_d$=1.6–40×10$^{-7}$ M) (Miller et al., Quiocho et al, Horlacher et al). Mutant maltose binding proteins can bind many of these substrates with even higher affinities (Telmer et al. J Biol Chem 278(36): 34555-67). The mutations of the last two altered base pairs converting Met (M) (position 347 of SEQ ID NO:1) and Gln (Q) position 351 of SEQ ID NO:1) to Ala (A) results in an increased affinity for maltose of $K_D$=70 nm (from 1200 nm), while the deletion of the first four amino acids (Glu (E) (position 198 of SEQ ID NO: 1), Asn (N) (position 199 of SEQ ID NO: 1), Lys (K) (position 201 of SEQ ID NO: 1) and Tyr (Y) (position 202 of SEQ ID NO: 1)) results in an increased affinity for maltose of $K_D$=110 nm, while the combination of both these mutations results in an increased affinity for maltodextrins and especially an increase in affinity for maltotriose of $K_D$=6 nm.

Models have been proposed for the binding of this protein with its substrates (Shilton et al). The three dimensional structure of this protein has been determined by several groups (Spurlino et al, Quiocho et al, Sharff et al) which have provided insight into critical bonds and molecular interactions between the substrates maltose, maltotriose and maltodextrose and maltose binding protein. This has allowed for proper design in the location of substrate linkage sites for labeling of maltose with the appropriate substrates for multimodal imaging.

Maltose binding protein is highly specific to the above listed substrates and is known not to bind glucose (Spurlino et al, Hulsmann et al), trehalose, lactose and sucrose (Hulsmann et al). Linear maltodextrins and cyclodextrins are broken down into monomers by enzymes in the intestines of mammals and therefore are not present in the blood or in cells outside of the intestinal tract making labeled maltose an excellent candidate for infusion into the blood. Maltose is also further broken down in the kidney by maltase. Maltose has been shown to be safe for intravenous infusion (Young et al, Finke et al). It has also been shown that infused maltose and oligosaccharides are distributed in the extracellular space (Finke et al). Infused maltose and oligosaccharides are also rapidly cleared from the body by the kidney (Finke et al, Sprandel et al). This allows for labeled maltose to be distributed to cells and subsequent, specific binding to occur in cells expressing the chimeric protein, while non-specific distribution of labeled maltose is rapidly cleared. Maltose has previously been labeled with radioactive isotopes ($^{14}$C, $^{13}$c, $^{15}$O), ANDS (Flux Instruments), Spin (Shin et al) and amino aromatic compounds (Nakajima et al).

Another way to control pharmacokinetics can be to express maltase in the bile pathway of the liver causing the catabolism of maltose in the bile ducts of the liver.

(3) Periplasmic Binding Proteins

Other extracellular binding proteins include periplasmic binding proteins from gram-negative bacteria, which include a family of over 50 different substrate-binding proteins, which bind with a varying degree of specificity to their substrate(s) with affinities of about 5×10$^{-7}$ M (Spurlino et al). These periplasmic binding proteins bind various carbohydrates, peptides, amino acids, metals or vitamins and are generally small proteins (De Wolf et al). Table 1 contains a summary of typical affinities for classes of extracellular surface receptors. Table 2 contains a list of periplasmic binding protein genes, other binding domains, transmembrane domains, and ligands. It is understood that certain classes of binding domains bind their substrates with dissociation constants of less than or equal to 1.6-40×10$^{-7}$, 5.0×10$^{-7}$6×10$^{-16}$ & 4×10$^{-14}$, or 20×10$^{-9}$.

TABLE 1

| Binding Protein | Kinetics (Kd (M)) |
| --- | --- |
| Maltose Binding Protein | 1.6-40 × 10$^{-7}$ |
| Other Periplasmic Binding Proteins | 5.0 × 10$^{-7}$ |
| Avidin/Streptavidin | 6 × 10$^{-16}$ & 4 × 10$^{-14}$ |
| Antibodies | Up to 20 × 10$^{-9}$ |

TABLE 2

| Periplasmic Binding Protein Gene | Ligand | GeneID (*Escherichia coli* K12) | Accession Number | SEQ ID NO: |
| --- | --- | --- | --- | --- |
| BtuE | Vitamin B12 | 945915 | AE000266 | 3 |
| DppA | Dipeptides | 948062 | AE000431 | 5 |
| FecB | Iron Dicitrate | 946838 | AE000499 | 7 |
| FepB | Ferric enterobactin | 947538 | AE000164 | 9 |
| FhuD | Iron Hydroxamate | 947510 | AE000124 | 11 |
| ModA | Molybdate | 945364 | AE000179, D90715 | 13 |
| MalE | Maltose | 948538 | AE000476 | 15 |
| NikA | Nickle | 947981 | AE000423 | 17 |
| PhnD | Alkyle phosphonate | 948624 | AE000482 | 19 |
| potD | Putrecine/spermidine | 945682 | AE000212, D90747 | 21 |
| PotF | Putrecine | 945480 | AE000187, D90723 | 23 |
| IpcA | heptose | 949134 | AE000131 | 25 |
| Sbp | Sulfate | 948411 | AE000466 | 27 |
| SfuA | thiamine | | | 29 |
| XylF | xylose | 948090 | AE000434 | 31 |
| YcjN | sugars | 945696 | AE000229 | 33 |
| YdcS | spermidine/putracine potential peptide binding protein | 946005 | AE000241 | 35 |
| YddS | Swiss-Prot: P76128 potential choline binding protein | 946052 | AE000245 | 37 |
| YehZ | Swiss-Prot: P33362 | 946681 | AE000302 | 39 |
| YejA | Oligopeptides | 946675 | AE000307 | 41 |

TABLE 2-continued

| | | | | |
|---|---|---|---|---|
| YgiS | Oligopepetides 17.3 kD protein in murA-rpoN intergenic region precursor Swiss-Prot: | 947140 | AE000384 | 43 |
| YhbN | P38685 | 947920 | AE000399 | 45 |
| YhdW | Amino acids | 947766 | AE000405 | 47 |
| AlsB | D allose | 948604 | AE000482 | 49 |
| YliB | peptides | 945449 | AE000185 | 51 |
| YneA | sugars | 945418 | AE000249 | 53 |
| YphF | sugars | 947020 | AE000340 | 55 |
| YtfQ | sugars | 948746 | AE000494 | 57 |

| Other Binding Domains | Unigene | LOC# | Accession Number | |
|---|---|---|---|---|
| Avidin | Gga.729 | LOC396260 | NA | 59 |
| Streptavidin | NA | NA | P22629 | 61 |
| GST | gga.2533 | NA | NA | 63 |
| Cd44 | Cfa.3800 | NA | NA | 65 |

| Trasmembrane Domains | Unigene | GeneID (mouse) | | |
|---|---|---|---|---|
| EGFR | Mm.8534 | 13649 | sp: Q01279 | 67 |
| PDGFR | Mm.4146 | 18596 | X04367 | 69 |
| PDGFRb | Mm.4146 | | X04367 | |
| Hap1 | Mm.281700 | | NP_034534.1 | |
| IGFR1 | Rn.10957 | | sp: Q60751 | |
| HLA-B7 | Hs.73917 | | NP_067258.1- | |

| Ligands | Unigene | | | |
|---|---|---|---|---|
| hyaluronan | Rn.1120 | | | 71 |
| biotin | At.10203 | | | 73 |
| glutathione | Mtr.2915 | | | 75 |
| Hyaluronan | Rn.1120 | | | |
| Biotin | At.10203 | | | |
| Glutathione | Mtr.2915 | | | |
| IGK Leader Sequence | | 111502 | | |
| Tyrosine Hydroxylase | Mm.1292 | 21823 | | |
| Tyrosine Hydroxylase Promoter | | | AF415235 | 15811609 |
| Maltose Binding Protein & Promoter | | | J01648 | 146697 |
| GST | | | NM000852 | 6552334 |
| BCL2 Promoter | | | NM000657 | 4557356 |

| Drug Resistance Proteins | | | | |
|---|---|---|---|---|
| MDR/TAP | | | NM000927 | 42741658 |
| CFTR/MRP | | | NM000392 | 4557480 |
| MBP | | | BX842579 | 41353667 |

(4) Avidin and Streptavidin

Avidin and Streptavidin are proteins that are well known for their ability to bind biotin with exceptionally high affinity ($K_d$=6×10$^{-6}$ for avidin and 4×10$^{-14}$ for streptavidin (Wilchek et al). Because of their high binding affinities these proteins have been used in numerous applications ranging from protein purification to drug targeting. Biotin has been conjugated to a large number of substrates. Avidin/Streptavidin have been shown to bind four biotin monomers enabling higher signal potential (Purgliese et al).

(5) cd-44

Cd-44 is a hyaluronan binding receptor that is widely expressed and is found in a variety of isoforms (Bajorath et al). Hyaluronan is a large (m.w.=up to 10×10$^6$ DaVestweber et al)) polyanionic glycosaminoglycan which is composed of the repeating disaccharide units β-(1,3)-N-acetyl-D-glucosamine and β-(1,4)-D-glucuronic acid. This polymer has been well characterized allowing for ideal conjugation of this polymer to a variety of substrates. The Cd-44 receptor has also been well characterized (Vestweber et al). Isoforms of this receptor that are highly specific to a modified ligand can also be used.

(6) Antibodies

There are numerous proteins that can be used which are recognized by specific antibodies. Antibodies are well characterized and are known for their capability to bind with high affinity (up to $K_d$=10-20×10$^{-9}$ M (Schier et al, Chen et al, Yang et al)) to a very specific ligand. Minibodies and diabodies are fragments of antibodies that contain the specific binding region(s) (variable region(s)) of the antibody, and can be modified for a specific purpose such as radioactive labeling for PET (Sundaresan et al).

The antibody, minibody or diabody binding proteins that can be used with the methods disclosed herein are those with low toxicity and immunogenicity, and that are not ubiquitously expressed. Antibodies have been conjugated to numerous substrates.

The antibody, minibody, or diabody can either be the binding domain or the substrate. For example, the antibody, minibody, or diabody can be a binding domain, as antibodies, minibodies, diabodies can be produced that bind any substrate, which could be used as discussed herein. The sequence of antibodies, minibodies, diabodies can be determined, and the cDNA producing them isolated, or a DNA molecule can be generated which encodes the antibodies, minibodies, or diabodies so that they can be operably linked to the transmembrane and/or cleavable hinges.

Likewise, the protein or peptide which the antibody, minibody, or diabody, bind could be the binding domain, and the antibody, minibody, or diabody could be used as the substrate as discussed herein.

c) Cleavable Hinges

Any hinge region can be used, including any cleavable hinge. A cleavable extracellular "hinge" between the chimeric protein's transmembrane domain and the receptor allows for customized pharmacodynamics as well as steady-state versus real-time gene reporting. By creating a hinge, cells saturated by the ligand can be cleared at a predictable and customizable rate defined by the rate of hinge cleavage. If the chimeric protein's control is under the control of a specific promoter of interest, the detected signal for the chimeric protein reporter can reflect long-term gene expression if the hinge were cleaved slowly, or real-time gene expression if the hinge were cleaved rapidly. In other words, the cleavable hinge allows for the ability to control the pharmacokinetic rate at which the bound substrate is cleared.

The complement cascade offers a wide variety of cleavable factors. For example, Tan et al (PNAS 87:162-166, 1990) characterized a series of genetically engineered chimeric human IgG3 and IgG4 anti-dansyl (DNS) antibodies with identical antibody-combining sites but different hinge region amino acid compositions to determine how the hinge region influences Fab fragment segmental flexibility, C1q binding, and complement activation. The hinge region is essential for C1q binding and complement activation. IgG1-IgG4 all have hinges which are useful with the disclosed methods.

Other examples of hinges are those found in the coagulation cascade, such as serine proteases including many of the serine proteases such as factors VII, IX, and X. A large part of research has been dedicated to elucidate the mechanisms involved in the coagulation cascade, therefore the kinetics and mechanisms behind the cleavage of these proteins have been well characterized. (see Table 3). Circulating levels of some of these enzymes are low but it would be possible to inject formulations of activated prothrombin and activated factor VIIa. Also, it would be possible to intravenously administered downstream cleavage targets of Factor IIa and Factor VIIa in order to augment cleavage. See references: PMID: 11487018, PMID: 15260820, PMID: 12823871 PMID: 11979750, PMID: 11503968, PMID: 11092213, PMID: 15175794). Table 4 shows possible combinations that could be used for the transmembrane, hinge and binding regions of the receptor.

TABLE 3

| Hinge Sites of Cleavage | | |
|---|---|---|
| factor | Site(s) of cleavage | protein ID |
| V | (arg709), (arg1018), (arg1545) | AAQ55063 |
| Va | (arg306), (arg506), (arg679) | |
| VII | Arg152 | AAL66184 |
| VIII | (arg372), (arg740), (arg1689) | EZHU |
| VIIIa | (arg336), (arg562) | |

TABLE 3-continued

| Hinge Sites of Cleavage | | |
|---|---|---|
| factor | Site(s) of cleavage | protein ID |
| X | Arg194 | AAH46125 |
| C2 | See Kam et al | AAB67975 |
| C3 | See Kam et al | AAR89906 |
| thrombin receptor | see Ishii et al | |
| Par1 | see Takeuchi et al | |
| Par3 | see Takeuchi et al | |

Cleavage sites which can be used with the disclosed compositions and methods can be found in, for example, Kam et al., "Human Complement Proteins D, C2, and B," J. Biol. Chem. 262(8):3444-3451 (1987); Bjorkman, S, and E. Bemtorp (2001). "Pharmacokinetics of coagulation factors: clinical relevance for patients with haemophilia." Clin Pharmacokinet 40(11): 815-32, Ishii, K., L. Hein, et al. (1993). "Kinetics of thrombin receptor cleavage on intact cells. Relation to signaling." J Biol Chem 268(13): 9780-6, Jacobsen, J. and K. Poulsen (1990). "In vivo generation and elimination of angiotensin in the rat." Clin Exp Pharmacol Physiol 17(6): 445-51, Lappin, D., A. D. Hamilton, et al. (1986). "Synthesis of complement components (C3, C2, B and C1-inhibitor) and lysozyme by human monocytes and macrophages." J Clin Lab Immunol 20(3): 101-5, Peake, P. W., J. A. Charlesworth, et al. (1991). "Activation of rabbit C3: studies of the generation of cleavage products in vitro and of their metabolism in vivo." Complement Inflamm 8(5-6): 261-70, Rand, M. D., S. R. Hanson, et al. (1995). "Factor V turnover in a primate model." Blood 86(7): 2616-23, Takeuchi, T., J. L. Harris, et al. (2000). "Cellular localization of membrane-type serine protease 1 and identification of protease-activated receptor-2 and single-chain urokinase-type plasminogen activator as substrates." J Biol Chem 275(34): 26333-42, van Dieijen, G., G. Tans, et al. (1981). "The role of phospholipid and factor VIIIa in the activation of bovine factor X." J Biol Chem 256(7): 3433-42, all of which are incorporated herein by reference for at least material related to hinge regions, including their sequences.

Figure 3:
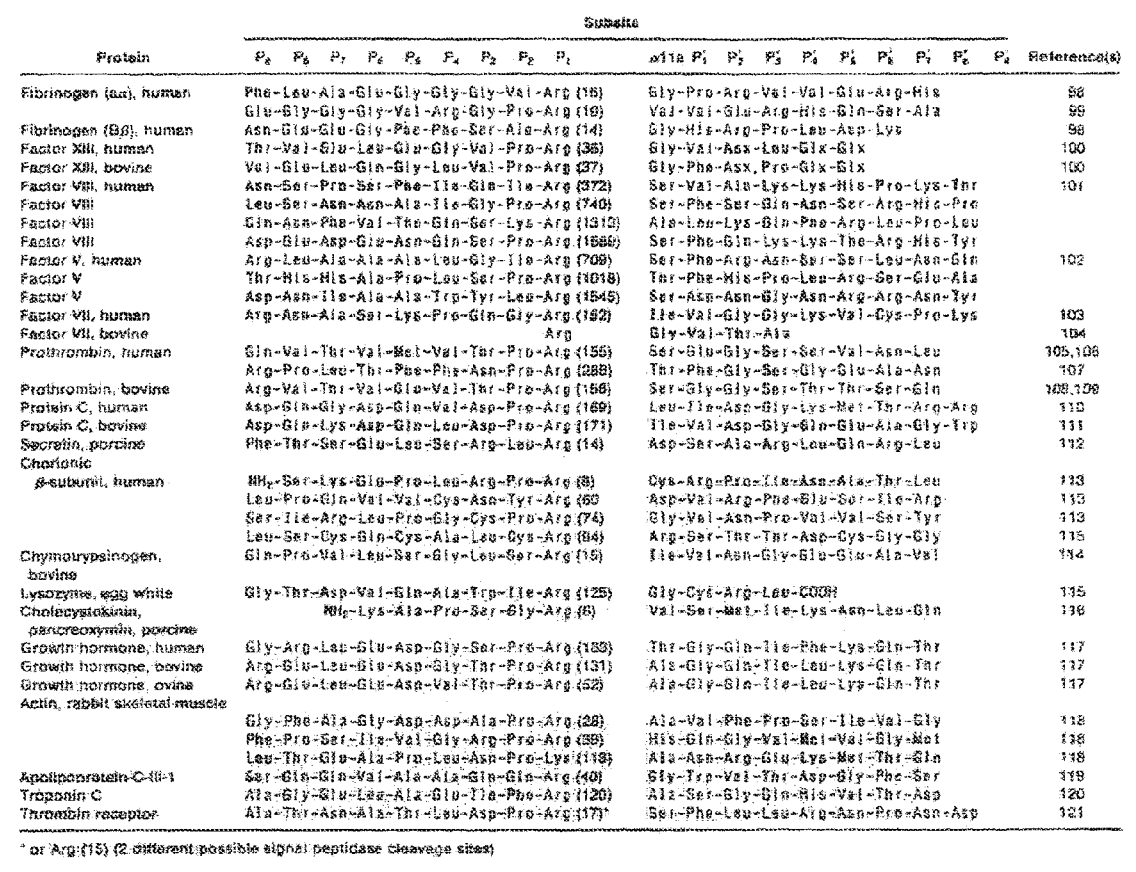

FIG. 3 shows cleavage sites for various indicated proteins, all of which can be used as hinge regions in the compositions and methods disclosed herein. This figure is taken from Cleavage Site Sequences Obtained From: Hemostasis and Thrombosis: Basic Priciples and Clinical Practice, 4th Edition, Colman R W, Hirsh J, Marder V J, Clowes A W, George J N (eds) J.B. Lippincott Company, Philadelphia, 2000, which is incorporated herein at least for material related cleavage sites and the enzymes which cleave them.

FIG. 4 shows cleavage regions of C2 and C3 complement, shown in SEQ ID NOs:88 and 89. These cleavage sites can also be used as hinges in the disclosed compositions and methods.

Disclosed are hinge regions which are cleavable in less than or equal to 15 minutes, 30 minutes, 45 minutes, 60 minutes, 1 hour, 2 hours, 4 hours, 4 hours, 5 hours, 6 hours, 7 hours, 8 hours, 9 hours, 10 hours, 15 hours, 20 hours, 30 hours, 40 hours, 50 hours, 75 hours, 100 hours, 150 hours, 200 hours, or longer.

Table 4 shows some various combinations of transmembrane domains, hinge regions, and binding domains. These can be combined in any possible combination, and it is understood that these are just representative, as others can be used as well.

TABLE 4

Possible Combinations of Transmembrane Domains, Hinges and Binding domains

| Transmembrane Domain | Hinge (T ½ = (hrs)) | Binding domain |
|---|---|---|
| EGFR | C2 (15 min.) | Avidin |
| PDGFRa | C3 (29) | Streptavidin |
| PDGFRb | Factor IX (30+) | GST |
| Hap1 | Factor X (30 min-1 hr.) | Cd44 |
| IGFR1 | angiotensinogen cleaveage site (1 min.) | BtuE |
| HLA-B7 | Factor V (13) | DppA |
|  | Factor VIIa (2-3) | FecB |
|  | Factor VIII (14) | FepB |
|  |  | FhuD |
|  |  | ModA |
|  |  | MalE |
|  |  | (maltose binding protein) |
|  |  | NikA |
|  |  | PhnD |
|  |  | potD |
|  |  | PotF |
|  |  | IpcA |
|  |  | Sbp |
|  |  | SfuA |
|  |  | XylF |
|  |  | YcjN |
|  |  | YdcS |
|  |  | YddS |
|  |  | YehZ |
|  |  | YejA |
|  |  | YgiS |
|  |  | YhbN |
|  |  | YhdW |
|  |  | AlsB |
|  |  | YliB |
|  |  | YneA |
|  |  | YphF |
|  |  | YtfQ |

5. Imaging Reporters Expression

The disclosed imaging reporters can be produced by any vector system to deliver a nucleic acid encoding the imaging reporter to one or more cells. For example, the imaging reporters can be associated with a cre-lox vector system in which a repressor (polyadenylation signal/transcriptional termination signal) of the promoter of the nucleic acid encoding imaging reporter is flanked by lox sites. In the absence of Cre, the imaging reporter is not expressed. For example, animals, such as mice can be produced using a cre-lox repressor vector. These animals have the construct encoding the imaging reporter present in every cell, but no cell is expressing the imaging reporter. These mice can then be, for example, crossed with mice that have Cre expressed under a cell specific or tissue specific promoter producing a mouse that will express the imaging reporter in a desired subset of cells or tissues. The methods of making these animals using the constructs disclosed herein, as well as the animals themselves are disclosed herein.

The chimeric receptor consisting of a transmembrane region (PDGFR) and binding region (Maltose Binding Protein or MBP) can be expressed from a ubiquitous promoter such as the Rosa26 promoter. Using Cre/Lox technology it is possible to control the time and place at which the receptor is expressed. As discussed above, Cre is an enzyme which recognizes a specific 34 base-pair sequence of DNA known as a LoxP site. If two of these sites are present within the DNA sequence the Cre protein will recombine the DNA between the LoxP sites thus excising the DNA in between these sites. The chimeric receptor has been designed to be expressed from the Rosa26 locus allowing for expression of the chimeric receptor anywhere in the mouse. Following the Rosa26 promoter is a strong stop signal (composed of four poly adenylation sequences (FIG. 5) and then the sequence for the chimeric receptor. Insertion of this stop signal prevents the chimeric receptor from being expressed until the signal is removed. Upon addition of Cre (which can be independently expressed from a cell/tissue specific promoter or injected as a protein) the stop sequence is removed therefore allowing expression of the chimeric receptor from cells exposed to Cre. Examples of Cre systems can be found in "Conditional Mouse Models of Sporadic Cancer", Jos Jonkers and Anton Berns, Nature Reviews, Cancer, Volume 2 Apr. 2002, and in "Cre Reporter Strains Produced by Targeted Insertion of EYFP and ECFP into the Rosa26 Locus", Shankar Srinivas et al, BMC Developmental Biology 1:4 2001; both incorporated by reference in their entirety for their teachings regarding imaging reporters and expression systems.

6. Inducible Expression

This invention permits non-invasive or minimally invasive real-time and steady state imaging (through control of the pharmacokinetics) of genetically modified tissues and cells of transgenic animals across multiple imaging modalities. This transgene-encoded reporter system, producing imaging reporters, can be driven, by any tissue-specific promoter or genetic locus. One example can be a chimeric receptor which is ubiquitously present and silent (not expressed as a protein) until expression is induced using Cre-LoxP mediated excision, allowing for expression of this chimeric protein at a desired time and location based on the expression of Cre recombinase (by using spatially-restricted and temporally inducible promoter elements for Cre or by direct injection of the Cre enzyme, etc.).

An artificial type of promoter regulation can be achieved with the Cre/lox system. In one example, a transgenic organism with a ubiquitous promoter is attached to the gene to be controlled. In between the promoter and the gene a 'stop' sequence surrounded with loxP sites is inserted. The stop sequence is a short sequence with several transcriptional stop codons that will prevent the gene from producing a protein. Alternatively, this sequence encodes a repressor that is excised using Cre, thereby discontinuing repression of the desired gene product. Cre+ cells and transgenic animals are well known in the art and readily available.

The cre/loxP system utilizes the ere (cyclization recombination) gene, which encodes the site-specific DNA recombinase Cre. These sites are known as loxP (locus of X-over P1) sequences, which are 34 base pairs long. When cells that have loxP sites in their genome also express Cre, the protein catalyzes a reciprocal recombination event between the loxP sites. loxP sequences can be artificially inserted into animals or plants and used for the precise excision of DNA.

7. Monitoring/Imaging

In vivo monitoring can be carried out using, for example, bioluminescence imaging, planar gamma camera imaging, SPECT imaging, light-based imaging, magnetic resonance imaging and spectroscopy, fluorescence imaging (especially in the near infrared), diffuse optical tomography, ultrasonography (including untargeted microbubble contrast, and targeted microbubble contrast), PET imaging, fluorescence correlation spectroscopy, in vivo two-photon microscopy, optical coherence tomography, speckle microscopy, small molecule reporters, nanocrystal labeling and second harmonic imaging, as well as others. Massoud et al. provide a detailed review of molecular imaging technologies (Genes and Development, 17:545-580, 2003), which is herein incorporated in its entirety for its teaching regarding molecular imaging.

a) Radionucleotide Imaging

Positron emission tomography (PET) records high-energy γ-rays emitted from within the subject. Natural biological molecules can be labeled with a positron-emitting isotope that is capable of producing two γ-rays through emission of a positron from its nucleus, which eventually annihilates with a nearby electron to produce two 511,000-eV γ-rays at ~180° apart. Positron-emitting isotopes frequently used include $^{15}O$, $^{13}N$, $^{11}C$, and $^{18}F$, the latter used as a substitute for hydrogen. Other less commonly used positron emitters include $^{14}O$, $^{64}Cu$, $^{62}Cu$, $^{124}I$, $^{76}Br$, $^{82}Rb$, and $^{68}Ga$. Most of these isotopes are produced in a cyclotron (Strijckmans 2001), but some can be produced using a generator (e.g., $^{68}Ga$, $^{82}Rb$). Labeled molecular probes (see below) or tracers can be introduced into the subject, and then PET imaging can follow the distribution and concentration of the injected molecules. Many of the positron-emitting isotopes used have relatively short half-lives (e.g., $^{18}F$ has $t_{1/2}$=110 min), so that the chemical reactions leading to incorporation of the isotope into the parent molecule and subsequent introduction into the subject take place relatively quickly.

γ-Emitting isotopes (e.g., $^{99m}Tc$, $^{111}In$, $^{123}I$, $^{131}I$) can also be used for imaging living subjects and require gamma cameras, which when rotated around the subject (single photon emission computed tomography, SPECT), can result in production of tomographic images. (Rosenthal et al. 1995).

Detection of γ-rays is achieved through scintigraphic instrumentation, which consists of an array of scintillation crystals to convert γ-ray energy into visible light, suitable light sensors, readout electronics, and image processing units (Ziegler 2000). The coincidence detection of both γ-rays in PET within nanoseconds of each other defines the line of response in space and thus the direction of flight. In contrast to SPECT, attenuation (quantifiable reduction in events present at the face of the detector due to absorption or scatter through tissues) of the emitted radiation in PET can be corrected precisely because the total length through the body determines the attenuation factor along a coincidence line. By doing so, quantitative information about the tracer distribution can be obtained. The reconstruction software then takes the coincidence events measured at all angular and linear positions to reconstruct an image that depicts the localization and concentration of the positron-emitting radioisotope within a plane of the organ that was scanned. If single photon emitters are used, the direction of flight has to be determined by geometric collimation. Because the emission of γ-rays from the subject is isotropic, such collimation is needed to restrict data to γ-rays of certain predefined directions. The main difference between SPECT and PET measurements is the necessity of lead collimators for the definition of the angle of incidence, compared with electronic collimation in the case of PET.

The sensitivity of PET is in the range of $10^{-11}$-$10^{-12}$ mole/L, and is independent of the location depth of the reporter probe of interest. Typically, several million cells accumulating reporter probe have to be in relative close proximity for a PET scanner to record them as a distinct entity relative to the background. In SPECT, collimator design is always a compromise between spatial resolution and sensitivity: reducing the size of the holes or using longer septae improves spatial resolution but reduces sensitivity at the same time. The use of collimators in SPECT results in a very low detection efficiency of ~$10^{-4}$ times the emitted number of γ-rays. PET is therefore at least a log order more sensitive than SPECT. For example, even a triple-head SPECT system designed to image $^{99m}Tc$-labeled tracers in the human brain is 15 times less sensitive than a PET if a 1-cm resolution is assumed in both systems (Budinger 1996). One alternative to PET that attempts to overcome sensitivity limitations, and that can also be adapted to available clinical systems, is "pinhole SPECT" for imaging small animals, with a reported spatial resolution as high as 1.7 mm. Even higher resolutions (200 µm) are possible with micropinhole apertures and $^{125}I$ SPECT imaging (Beekman et al. 2002).

The images from a PET scanner, although often shown in color, reflect identical-energy γ-ray events, and the color scale usually reflects the concentration of isotope in various locations of the body. The spatial resolution of most clinical PET scanners is ~$(6-8)^3$ mm$^3$, but higher-resolution clinical brain scanners have been developed approaching resolutions of ~$3^3$ mm$^3$.

Small animal micro-PET scanners have also been developed. These systems typically have a spatial resolution of ~$1^3$ mm$^3$ (Cherry and Gambhir 2001). Development of molecular imaging assays with PET is particularly advantageous because of the ability to validate them in cell culture and small animal models prior to using the same reporter probe in established clinical PET centers around the world. The ability to perform translational research from a cell culture setting to preclinical animal models to clinical applications is one of the most unique and powerful features of PET technology (Chemy and Gambhir (2001), Luker and Piwnica-Worms (2001), Price (2001), Reader and Zweit (2001), and Chatziioannou (2002).)

b) Optical Imaging

Optical imaging techniques have been developed for in vitro and ex vivo applications in molecular and cellular biology (e.g., fluorescence microscopy and in benchtop luminometry using commercial substrate kits for bioluminescence). An extension of this concept toward noninvasive in vivo imaging with light photons allows for extracting relevant biological information from living subjects (Weissleder 2001).

A fundamental issue in optical imaging of living subjects is how to detect light emitted from the body, this being relevant to both bioluminescence and fluorescence imaging. In this regard, several technical advances for imaging very low levels of visible light have emerged, allowing the use of highly sensitive detectors in living subjects, and not just restricted to cell cultures and small transparent animals. Charged coupled device (CCD) detectors are made of silicon crystals sliced into thin sheets for fabrication into integrated circuits using similar technologies to those used in making computer silicon chips (Spibey et al. (2001)). One of the properties of silicon-based detectors is their high sensitivity to light, allowing them to detect light in the visible to near-infrared range. CCD cameras operate by converting light photons at wavelengths between 400 and 1000 nm that strike a CCD pixel with an energy of just 2-3 eV (as opposed to high-energy γ-rays of 511 keV in PET that would easily traverse a CCD chip) into electrons. A CCD contains semiconductors that are connected so that the output of one serves as the input of the next. In this way, an electrical charge pattern, corresponding to the intensity of incoming photons, is read out of the CCD into an output register and amplifier at the edge of the CCD for digitization. For bioluminescence imaging, CCD cameras can be mounted in a light-tight specimen chamber, and are attached to a cryogenic refrigeration unit (for camera cooling to 120° C. to 150° C.). A camera controller, linked to a computer system, is used for data acquisition and analysis. A bioluminescence image can be shown as a color image that is superimposed on a gray-scale photographic image of the small animal using overlay and image analysis software. A region of interest is manually selected over an area of signal intensity, and the maximum or average intensity is recorded as photons per second per centimeter squared per steradian (a steradian is a unit of solid angle; Wu et al. 2001).

The main advantage of optical bioluminescence imaging is that it can be used to detect very low levels of signal because the light emitted is virtually background-free (see below). It is quick and easy to perform and allows rapid testing of biological hypotheses and proofs of principle in living experimental models. It is also uniquely suited for high-throughput imaging because of its ease of operation, short acquisition times (typically 10-60 sec), and the possibility of simultaneous measurement of six or more anesthetized living mice (Vooijs et al. 2002).

In fluorescence imaging, an excitation light of one wavelength (in the visible light range of 395-600 nm) illuminates the living subject, and a CCD camera (Golden and Ligler 2002) collects an emission light of shifted wavelength. Cells tagged with fluorescently labeled antibodies or those in which expression of the green fluorescent protein (GFP) gene (or its variants; Lippincott-Schwartz et al. 2001; Remington 2002) is introduced can be followed by this technique. GFP is a protein from the jellyfish *Aequorea victoria*. Wild-type GFP emits green (509-nm) light when excited by violet (395-nm) light. The variant EGFP has a shifted excitation spectrum to longer wavelengths and has increased (35-fold) brightness. Between 1000 and 10,000 fluorescently-labeled cells in the peritoneal cavity of a mouse can be imaged on its external surface (Kaneko et al. 2001). The two main advantages of fluorescence imaging are that it can be used as a reporter in both live and fixed cells/tissues and no substrate is required for its visualization (Spergel et al. 2001). This simple, reflectance type of fluorescence imaging has been used extensively in studies of feasibility and development of these approaches (Kamiyama et al. 2002; X. Li et al. 2002).

In contrast to fluorescence imaging in the visible light range, the use of the near-infrared (NIR) spectrum in the 700-900-nm range maximizes tissue penetration and minimizes autofluorescence from nontarget tissue (Weissleder 2002). This is because hemoglobin and water, the major absorbers of visible and infrared light, respectively, have their lowest absorption coefficients in the NIR region. Several NIR fluorochromes are available (Lin et al. 2002) that can be coupled to affinity molecules (peptides, antibodies) or that are activatable.

Another approach to fluorescence imaging of deeper structures uses fluorescence-mediated tomography (Ntziachristos and Weissleder 2002; Ntziachristos et al. 2002). The subject is exposed to continuous wave or pulsed light from different sources, and detectors arranged in a spatially defined order in an imaging chamber capture the emitted light. Mathematical processing of this information results in a reconstructed tomographic image. Resulting images have a resolution of 1-2 mm, and the fluorochrome detection threshold is in the nanomolar range.

c) Magnetic Resonance Imaging

The fundamental principle underlying MRI is that unpaired nuclear spins, called magnetic dipoles (such as hydrogen atoms in water and organic compounds), align themselves when placed into a magnetic field. In an MRI scanner, there is a strong magnet that produces a magnetic field surrounding the subject under investigation. There are also "coils" within the magnet to produce a gradient in this magnetic field in the X, Y, and Z directions. The magnet also contains a radiofrequency coil that can produce a temporary radiofrequency pulse to change the alignment of the spins. Following the pulse, the magnetic dipoles return to their baseline orientation, which is detected (also by the radiofrequency coil) as a change in electromagnetic flux (radiofrequency waves in the range 1-100 MHz). A function of the scanner is to determine the rate at which these dipoles relax to their baseline orientation; this measurement is translated into an MR signal. Dipoles in different physicochemical environments will have different relaxation times and, thus, generate different MR signals (Jacobs and Chemy 2001). For example, dipoles in a fat- or hydrocarbon-rich environment will have significantly shorter (up to 20×) relaxation times than dipoles in an aqueous environment (Hornack 2002). This is one of the main ways by which image contrast is achieved in MRI. The timing parameters of pulse excitation and recording can be altered by a central computer, resulting in images with different types of magnetic contrast. The two most frequently used timing parameters are known as T1 and T2 weighting. MRI is exquisitely sensitive to soft-tissue differences and abnormalities (Lewin et al. 1999; Shaharabany et al. 2001; Song et al. 2002). The addition of chemical agents that change the MR signal intensity near these abnormalities may also be used to enhance signal differences and to further highlight the abnormality. Specifically, paramagnetic metal cations such as chelated gadolinium or dysprosium, or superparamagnetic nanoparticles (Moore et al. 1997, 2000; Weissleder et al. 1997a; Turetschek et al. 2001), can be used as compartmental, targeted, or smart probes with this technique. The development of novel contrast agents is an active area in both clinical and basic research.

A new extension of MRI techniques to imaging mice is that of magnetic resonance microscopy. This allows for the nondestructive image of a whole perfusion-fixed killed mouse (the "Visible Mouse" atlas project; Johnson et al. 2002) with isotropic three-dimensional spatial resolution as small as 110 μm ($1 \times 10^3$ mm$^3$) and spatial resolution in isolated organs as small as 25 μm ($1.6 \times 10^{-5}$ mm$^3$).

Variations on standard MRI techniques for greater functional analysis include diffusion-weighted MRI, which exploits the translational mobility of water molecules to obtain information on the microscopic behavior of tissues (presence of macromolecules, presence and permeability of membranes, equilibrium of intracellular-extracellular water); and perfusion-weighted MRI, which makes use of endogenous and exogenous reporter probes for monitoring their hemodynamic status.

Another example of the use of magnetic resonance in imaging applies to magnetic resonance spectroscopy (MRS), in which characteristic imaging spectra, composed of specific resonance frequencies absorbed by a small volume of a sample or tissue, are obtained from the tissue subjected to magnetic resonance. These spectra depend on the chemical or "molecular" composition of the sample or tissue. The most useful nuclei for MRS are hydrogen, phosphorus, sodium, and, to a lesser extent, carbon. Hydrogen MR spectroscopy has a greater signal-to-noise ratio and better spatial resolution than phosphorus spectroscopy. The most interesting MR spectral components in living subjects are those of metabolites and amino acids; for example, choline, creatine, N-acetyl aspartate (NAA), lactate, myoinositol, glutamine and glutamate, lipids, leucine, and alanine (Castillo et al. 1996). The concentration of most metabolites is typically orders of magnitude less than that of the water or fat signal in tissues. Therefore, the $^1$H MRI signals from water and fat must be suppressed when performing $^1$H spectroscopy of metabolites. There are emerging applications for MRS in molecular imaging. For example, Stegman et al. (1999) have used MRS in mice to demonstrate the feasibility of monitoring expression of the cytosine deaminase transgene in tumors. Noninvasive measurement of gene expression in murine muscle using MRS has also been developed to monitor gene therapy in mouse models of neuromuscular diseases (Fraites et al. 2002).

d) Computed Tomography Imaging

Images in computed tomography (CT) are obtained when component tissues differentially absorb X-rays as they pass through the body (Dendy and Heaton 1999). A low-energy X-ray source of 30-50 kVp (i.e., of considerably lower energy than in clinical CT scanners) and a detector rotate around the animal, acquiring volumetric data. Most mouse CT images are collected with high-resolution phosphor screen/CCD detectors to optimize image quality. A scan of an entire mouse at 100-µm resolution takes ~15 min. Higher-resolution (50-µm) images are achievable with longer scanning times. In its present use, computed tomography is not a "molecular" imaging technique per se, but instead, dedicated high-resolution micro-CT scanners are available for anatomical imaging of small animals (Paulus et al. 2001; Berger et al. 2002; Holdsworth and Thornton 2002), thus complementing the functional information obtained by other modalities discussed above.

e) Other Imaging Modalities

In ultrasonography, ultrasound images are obtained when high-frequency (>20-kHz) sound waves are emitted from a transducer placed against the skin and the ultrasound is reflected back from the internal organs under examination. Contrast in the images obtained depends on the imaging algorithm used, backscatter, attenuation of the sound, and sound speed. Ultrasound imaging using diagnostic ultrasound instrumentation operating in the 7.5-15 MHz frequency range has been successfully applied to a variety of mouse models (Turnbull and Foster 2002), yielding images with a spatial resolution of 300-500 µm. The role of ultrasonography in the spectrum of modalities available for mouse microimaging and phenotype analysis closely parallels its present role in clinical imaging. The strengths of ultrasound in cardiac, obstetric, vascular, and abdominal imaging appear most likely to extend to the mouse when the technology is scaled down to achieve high resolution and a level of practicality/functionality similar to that available with present clinical ultrasound systems. The real-time nature of ultrasound is also facilitating its application in image-guided injection procedures, enabling mouse embryos to be directly manipulated in utero when studying normal and diseased development. This visualization of small anatomical structures at the embryonic and early postnatal stages is possible using "ultrasound biomicroscopy": a high-frequency (20-100-MHz) pulse-echo ultrasound approach for imaging living biological tissues with near-microscopic resolution (50-100 µm; Turnbull and Foster 2002). This technique also allows color Doppler imaging for noninvasive blood velocity measurements and microcirculatory flow mapping.

Another embodiment is that of using targeted ultrasonic contrast agents for molecular imaging of specific cell-surface receptors, especially within the vascular compartment (Lanza and Wickline 2001). For example, angioplasty-induced expression of tissue factor by smooth muscle cells within the carotid arteries of pigs can be identified with a ligand-targeted acoustic nanoparticle system. Tissue factor-targeted emulsions were found to bind to overstretched smooth muscle cells and increase their echogenicity and gray-scale levels (Lanza et al. 2000).

Whole-body autoradiography is a type of animal imaging, such as small animal imaging, as well. It plays an important complementary role to radionuclide tracer quantification and distribution studies in rodent models following their being killed. Autoradiography is the detection of radioactive isotopes on X-ray film or digital plates, where the specimen is the source of the radiation. The isotope emissions form a latent image on the film that produces a final image upon development. This is often performed at the end of microPET studies to provide a standard against which PET images and data can be compared (Gambhir et al. 1998). The killed animal is frozen in carboxymethyl cellulose (CMC), and whole-body sections (20-45 µm) are obtained using a microtome. Sections are freeze-dried at −20° C. and placed on X-ray film for exposure. Different radionuclides require different exposures because of varying exposure efficiencies. Autoradiography has a wide range of spatial resolutions; microautoradiography, with resolution down to 0.05 µm, is used to locate tracers within or between cells. Macroautoradiography (whole-body autoradiography), with a resolution of 50 µm, is used to determine tracer concentration within tissues. Quantitative data can be obtained by densitometry using an isotope scale as a reference.

f) Multimodality Imaging

By computer software, high-resolution anatomical images from CT or MRI can be registered mathematically onto physiologically/functionally informative PET images of the same subject to produce a bimodality image (Townsend 2001; Townsend and Cherry 2001). Also contemplated is small-animal instrumentation that is integrated, thus housing different modalities in the same scanner, in the same mold as clinical CT/PET scanners (Townsend 2001). For example, combined radionuclide and magnetic probes allow near-simultaneous MRI and PET imaging (Example 9). Other combinations of optical, radionuclide, MRI, and CT techniques, and specifically designed dual-purpose probes (Bogdanov et al. 1998; Josephson et al. 2002) produce multimodal images.

C. Compositions

Disclosed are the components to be used to prepare the disclosed compositions as well as the compositions themselves to be used within the methods disclosed herein. These and other materials are disclosed herein, and it is understood that when combinations, subsets, interactions, groups, etc. of these materials are disclosed that while specific reference of each various individual and collective combinations and permutation of these compounds may not be explicitly disclosed, each is specifically contemplated and described herein. For example, if a particular nucleic acid is disclosed and discussed and a number of modifications that can be made to a number of molecules including the nucleotides are discussed, specifically contemplated is each and every combination and permutation of nucleotides and the modifications that are possible unless specifically indicated to the contrary. Thus, if a class of molecules A, B, and C are disclosed as well as a class of molecules D, E, and F and an example of a combination molecule, A-D is disclosed, then even if each is not individually recited each is individually and collectively contemplated meaning combinations, A-E, A-F, B-D, B-E, B-F, C-D, C-E, and C-F are considered disclosed. Likewise, any subset or combination of these is also disclosed. Thus, for example, the sub-group of A-E, B-F, and C-E would be considered disclosed. This concept applies to all aspects of this application including, but not limited to, steps in methods of making and using the disclosed compositions. Thus, if there are a variety of additional steps that can be performed it is understood that each of these additional steps can be performed with any specific embodiment or combination of embodiments of the disclosed methods.

1. Homology/Identity

It is understood that one way to define any known variants and derivatives or those that might arise, of the disclosed genes and proteins herein is through defining the variants and derivatives in terms of homology to specific known sequences. For example SEQ ID NO: 1 sets forth a particular sequence of an a specific targeting vector. Specifically disclosed are variants of these and other genes and proteins herein disclosed which have at least, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 percent homology to the stated-sequence. Those of skill in the art readily understand how to determine the homology of two proteins or nucleic acids, such as vectors. For example, the homology can be calculated after aligning the two sequences so that the homology is at its highest level.

Another way of calculating homology can be performed by published algorithms. Optimal alignment of sequences for comparison may be conducted by the local homology algorithm of Smith and Waterman Adv. Appl. Math. 2: 482 (1981), by the homology alignment algorithm of Needleman and Wunsch, J. Mol. Biol. 48: 443 (1970), by the search for similarity method of Pearson and Lipman, Proc. Natl. Acad. Sci. U.S.A. 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The same types of homology can be obtained for nucleic acids by for example the algorithms disclosed in Zuker, M. Science 244:48-52, 1989, Jaeger et al. *Proc. Natl. Acad. Sci. USA* 86:7706-7710, 1989, Jaeger et al. *Methods Enzymol.* 183:281-306, 1989, which are herein incorporated by reference for at least material related to nucleic acid alignment.

2. Hybridization/Selective Hybridization

The term hybridization typically means a sequence driven interaction between at least two nucleic acid molecules, such as a primer or a probe and a gene. Sequence driven interaction means an interaction that occurs between two nucleotides or nucleotide analogs or nucleotide derivatives in a nucleotide specific manner. For example, G interacting with C or A interacting with T are sequence driven interactions. Typically sequence driven interactions occur on the Watson-Crick face or Hoogsteen face of the nucleotide. The hybridization of two nucleic acids is affected by a number of conditions and parameters known to those of skill in the art. For example, the salt concentrations, pH, and temperature of the reaction all affect whether two nucleic acid molecules will hybridize.

Parameters for selective hybridization between two nucleic acid molecules are well known to those of skill in the art. For example, in some embodiments selective hybridization conditions can be defined as stringent hybridization conditions. For example, stringency of hybridization is controlled by both temperature and salt concentration of either or both of the hybridization and washing steps. For example, the conditions of hybridization to achieve selective hybridization may involve hybridization in high ionic strength solution (6×SSC or 6×SSPE) at a temperature that is about 12-25° C. below the Tm (the melting temperature at which half of the molecules dissociate from their hybridization partners) followed by washing at a combination of temperature and salt concentration chosen so that the washing temperature is about 5° C. to 20° C. below the Tm. The temperature and salt conditions are readily determined empirically in preliminary experiments in which samples of reference DNA immobilized on filters are hybridized to a labeled nucleic acid of interest and then washed under conditions of different stringencies. Hybridization temperatures are typically higher for DNA-RNA and RNA-RNA hybridizations. The conditions can be used as described above to achieve stringency, or as is known in the art. (Sambrook et al., Molecular Cloning: A Laboratory Manual, 2nd Ed., Cold Spring Harbor Laboratory, Cold Spring Harbor, N.Y., 1989; Kunkel et al. Methods Enzymol. 1987:154:367, 1987 which is herein incorporated by reference for material at least related to hybridization of nucleic acids). A preferable stringent hybridization condition for a DNA:DNA hybridization can be at about 68° C. (in aqueous solution) in 6×SSC or 6×SSPE followed by washing at 68° C. Stringency of hybridization and washing, if desired, can be reduced accordingly as the degree of complementarity desired is decreased, and further, depending upon the G-C or A-T richness of any area wherein variability is searched for. Likewise, stringency of hybridization and washing, if desired, can be increased accordingly as homology desired is increased, and further, depending upon the G-C or A-T richness of any area wherein high homology is desired, all as known in the art.

Another way to define selective hybridization is by looking at the amount (percentage) of one of the nucleic acids bound to the other nucleic acid. For example, in some embodiments selective hybridization conditions would be when at least about, 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the limiting nucleic acid is bound to the non-limiting nucleic acid. Typically, the non-limiting primer is in for example, 10 or 100 or 1000 fold excess. This type of assay can be performed at under conditions where both the limiting and non-limiting primer are for example, 10 fold or 100 fold or 1000 fold below their $k_d$, or where only one of the nucleic acid molecules is 10 fold or 100 fold or 1000 fold or where one or both nucleic acid molecules are above their $k_d$.

Another way to define selective hybridization is by looking at the percentage of primer that gets enzymatically manipulated under conditions where hybridization is required to promote the desired enzymatic manipulation. For example, in some embodiments selective hybridization conditions would be when at least about, 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the primer is enzymatically manipulated under conditions which promote the enzymatic manipulation, for example if the enzymatic manipulation is DNA extension, then selective hybridization conditions would be when at least about 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the primer molecules are extended. Preferred conditions also include those suggested by the manufacturer or indicated in the art as being appropriate for the enzyme performing the manipulation.

Just as with homology, it is understood that there are a variety of methods herein disclosed for determining the level of hybridization between two nucleic acid molecules. It is understood that these methods and conditions may provide different percentages of hybridization between two nucleic acid molecules, but unless otherwise indicated meeting the parameters of any of the methods would be sufficient. For example if 80% hybridization was required and as long as hybridization occurs within the required parameters in any one of these methods it is considered disclosed herein.

It is understood that those of skill in the art understand that if a composition or method meets any one of these criteria for determining hybridization either collectively or singly it is a composition or method that is disclosed herein.

3. Nucleic Acids

There are a variety of molecules disclosed herein that are nucleic acid based, including for example a vector. The disclosed nucleic acids are made up of for example, nucleotides, nucleotide analogs, or nucleotide substitutes. Non-limiting examples of these and other molecules are discussed herein. It is understood that for example, when a vector is expressed in a cell that the expressed mRNA will typically be made up of A, C, G, and U. Likewise, it is understood that if, for example, an antisense molecule is introduced into a cell or cell environment, through for example exogenous delivery, it is advantageous that the antisense molecule be made up of nucleotide analogs that reduce the degradation of the antisense molecule in the cellular environment.

a) Nucleotides and Related Molecules

A nucleotide is a molecule that contains a base moiety, a sugar moiety and a phosphate moiety. Nucleotides can be linked together through their phosphate moieties and sugar moieties creating an internucleoside linkage. The base moiety of a nucleotide can be adenin-9-yl (A), cytosin-1-yl (C), guanin-9-yl (G), uracil-1-yl (U), and thymin-1-yl (T). The sugar moiety of a nucleotide is a ribose or a deoxyribose. The phosphate moiety of a nucleotide is pentavalent phosphate. A non-limiting example of a nucleotide would be 3'-AMP (3'-adenosine monophosphate) or 5'-GMP (5'-guanosine monophosphate).

A nucleotide analog is a nucleotide that contains some type of modification to either the base, sugar, or phosphate moieties. Modifications to nucleotides are well known in the art and would include for example, 5-methylcytosine (5-me-C), 5-hydroxymethyl cytosine, xanthine, hypoxanthine, and 2-aminoadenine as well as modifications at the sugar or phosphate moieties.

Nucleotide substitutes are molecules having similar functional properties to nucleotides, but which do not contain a phosphate moiety, such as peptide nucleic acid (PNA). Nucleotide substitutes are molecules that will recognize nucleic acids in a Watson-Crick or Hoogsteen manner, but which are linked together through a moiety other than a phosphate moiety. Nucleotide substitutes are able to conform to a double helix type structure when interacting with the appropriate target nucleic acid.

It is also possible to link other types of molecules (conjugates) to nucleotides or nucleotide analogs to enhance for example, cellular uptake. Conjugates can be chemically linked to the nucleotide or nucleotide analogs. Such conjugates include but are not limited to lipid moieties such as a cholesterol moiety. (Letsinger et al., Proc. Natl. Acad. Sci. USA, 1989, 86, 6553-6556), A Watson-Crick interaction is at least one interaction with the Watson-Crick face of a nucleotide, nucleotide analog, or nucleotide substitute. The Watson-Crick face of a nucleotide, nucleotide analog, or nucleotide substitute includes the C2, N1, and C6 positions of a purine based nucleotide, nucleotide analog, or nucleotide substitute and the C2, N3, C4 positions of a pyrimidine based nucleotide, nucleotide analog, or nucleotide substitute.

A Hoogsteen interaction is the interaction that takes place on the Hoogsteen face of a nucleotide or nucleotide analog, which is exposed in the major groove of duplex DNA. The Hoogsteen face includes the N7 position and reactive groups (NH2 or O) at the C6 position of purine nucleotides.

b) Sequences

There are a variety of sequences related to, for example, SEQ ID NO: 1 as well as any other protein disclosed herein that are disclosed on Genbank, and these sequences and others are herein incorporated by reference in their entireties as well as for individual subsequences contained therein.

A variety of sequences are provided herein and these and others can be found in Genbank. Those of skill in the art understand how to resolve sequence discrepancies and differences and to adjust the compositions and methods relating to a particular sequence to other related sequences. Primers and/or probes can be designed for any sequence given the information disclosed herein and known in the art.

c) Primers and Probes

Disclosed are compositions including primers and probes, which are capable of interacting with the genes disclosed herein. In certain embodiments the primers are used to support DNA amplification reactions. Typically the primers will be capable of being extended in a sequence specific manner. Extension of a primer in a sequence specific manner includes any methods wherein the sequence and/or composition of the nucleic acid molecule to which the primer is hybridized or otherwise associated directs or influences the composition or sequence of the product produced by the extension of the primer. Extension of the primer in a sequence specific manner therefore includes, but is not limited to, PCR, DNA sequencing, DNA extension, DNA polymerization, RNA transcription, or reverse transcription. Techniques and conditions that amplify the primer in a sequence specific manner are preferred. In certain embodiments the primers are used for the DNA amplification reactions, such as PCR or direct sequencing. It is understood that in certain embodiments the primers can also be extended using non-enzymatic techniques, where for example, the nucleotides or oligonucleotides used to extend the primer are modified such that they will chemically react to extend the primer in a sequence specific manner. Typically the disclosed primers hybridize with the nucleic acid or region of the nucleic acid or they hybridize with the complement of the nucleic acid or complement of a region of the nucleic acid.

d) Functional Nucleic Acids

Functional nucleic acids are nucleic acid molecules that have a specific function, such as binding a target molecule or catalyzing a specific reaction. Functional nucleic acid molecules can be divided into the following categories, which are not meant to be limiting. For example, functional nucleic acids include antisense molecules, aptamers, ribozymes, triplex forming molecules, and external guide sequences. The functional nucleic acid molecules can act as affectors, inhibitors, modulators, and stimulators of a specific activity possessed by a target molecule, or the functional nucleic acid molecules can possess a de novo activity independent of any other molecules.

Antisense molecules are designed to interact with a target nucleic acid molecule through either canonical or non-canonical base pairing. The interaction of the antisense molecule and the target molecule is designed to promote the destruction of the target molecule through, for example, RNAseH-mediated RNA-DNA hybrid degradation. Alternatively the antisense molecule is designed to interrupt a processing function that normally would take place on the target molecule, such as transcription or replication. Antisense molecules can be designed based on the sequence of the target molecule. Numerous methods for optimization of antisense efficiency by finding the most accessible regions of the target molecule exist. Exemplary methods would be in vitro selection experiments and DNA modification studies using DMS and DEPC. It is preferred that antisense molecules bind the target molecule with a dissociation constant ($k_d$) less than or equal to $10^{-6}$, $10^{-8}$, $10^{-10}$, or $10^{-12}$. A representative sample of methods and techniques which aid in the design and use of antisense molecules can be found in the following non-limiting list of United States patents: U.S. Pat. Nos. 5,135,917, 5,294,533, 5,627,158, 5,641,754, 5,691,317, 5,780,607, 5,786,138, 5,849,903, 5,856,103, 5,919,772, 5,955,590, 5,990,088, 5,994,320, 5,998,602, 6,005,095, 6,007,995, 6,013,522, 6,017,898, 6,018,042, 6,025,198, 6,033,910, 6,040,296, 6,046,004, 6,046,319, and 6,057,437.

Aptamers are molecules that interact with a target molecule, preferably in a specific way. Typically aptamers are small nucleic acids ranging from 15-50 bases in length that fold into defined secondary and tertiary structures, such as stem-loops or G-quartets. Aptamers can bind small molecules, such as ATP (U.S. Pat. No. 5,631,146) and theophiline (U.S. Pat. No. 5,580,737), as well as large molecules, such as reverse transcriptase (U.S. Pat. No. 5,786,462) and thrombin (U.S. Pat. No. 5,543,293). Aptamers can bind very tightly with $k_d$s from the target molecule of less than $10^{-12}$ M. It is preferred that the aptamers bind the target molecule with a $k_d$ less than $10^{-6}$, $10^{-8}$, $10^{-10}$, or $10^{-12}$. Aptamers can bind the target molecule with a very high degree of specificity. For example, aptamers have been isolated that have greater than a 10000 fold difference in binding affinities between the target molecule and another molecule that differ at only a single position on the molecule (U.S. Pat. No. 5,543,293). It is preferred that the aptamer have a $k_d$ with the target molecule at least 10, 100, 1000, 10,000, or 100,000 fold lower than the $k_d$ with a background binding molecule. It is preferred when doing the comparison for a polypeptide for example, that the background molecule be a different polypeptide. For example, when determining the specificity of maltose binding protein aptamers, the background protein could be serum albumin. Representative examples of how to make and use aptamers to bind a variety of different target molecules can be found in the following non-limiting list of United States patents: U.S. Pat. Nos. 5,476,766, 5,503,978, 5,631,146, 5,731,424, 5,780,228, 5,792,613, 5,795,721, 5,846,713, 5,858,660, 5,861,254, 5,864,026, 5,869,641, 5,958,691, 6,001,988, 6,011,020, 6,013,443, 6,020,130, 6,028,186, 6,030,776, and 6,051,698.

Ribozymes are nucleic acid molecules that are capable of catalyzing a chemical reaction, either intramolecularly or intermolecularly. Ribozymes are thus catalytic nucleic acid. It is preferred that the ribozymes catalyze intermolecular reactions. There are a number of different types of ribozymes that catalyze nuclease or nucleic acid polymerase type reactions which are based on ribozymes found in natural systems, such as hammerhead ribozymes, (for example, but not limited to the following United States patents: U.S. Pat. Nos. 5,334,711, 5,436,330, 5,616,466, 5,633,133, 5,646,020, 5,652,094, 5,712,384, 5,770,715, 5,856,463, 5,861,288, 5,891,683, 5,891,684, 5,985,621, 5,989,908, 5,998,193, 5,998,203, WO 9858058 by Ludwig and Sproat, WO 9858057 by Ludwig and Sproat, and WO 9718312 by Ludwig and Sproat) hairpin ribozymes (for example, but not limited to the following U.S. Pat. Nos. 5,631,115, 5,646,031, 5,683,902, 5,712,384, 5,856,188, 5,866,701, 5,869,339, and 6,022,962), and tetrahymena ribozymes (for example, but not limited to the following U.S. Pat. Nos.: 5,595,873 and 5,652,107). There are also a number of ribozymes that are not found in natural systems, but which have been engineered to catalyze specific reactions de novo (for example, but not limited to the following United States patents: U.S. Pat. Nos. 5,580,967, 5,688,670, 5,807,718, and 5,910,408). Preferred ribozymes cleave RNA or DNA substrates, and more preferably cleave RNA substrates. Ribozymes typically cleave nucleic acid substrates through recognition and binding of the target substrate with subsequent cleavage. This recognition is often based mostly on canonical or non-canonical base pair interactions. This property makes ribozymes particularly good candidates for target specific cleavage of nucleic acids because recognition of the target substrate is based on the target substrates sequence. Representative examples of how to make and use ribozymes to catalyze a variety of different reactions can be found in the following non-limiting list of United States patents: U.S. Pat. Nos. 5,646,042, 5,693,535, 5,731,295, 5,811,300, 5,837,855, 5,869,253, 5,877,021, 5,877,022, 5,972,699, 5,972,704, 5,989,906, and 6,017,756.

Triplex forming functional nucleic acid molecules are molecules that can interact with either double-stranded or single-stranded nucleic acid. When triplex molecules interact with a target region, a structure called a triplex is formed, in which there are three strands of DNA forming a complex dependant on both Watson-Crick and Hoogsteen base-pairing. Triplex molecules are preferred because they can bind target regions with high affinity and specificity. It is preferred that the triplex forming molecules bind the target molecule with a $k_d$ less than $10^{-6}$, $10^{-8}$, $10^{-10}$, or $10^{-12}$. Representative examples of how to make and use triplex forming molecules to bind a variety of different target molecules can be found in the following non-limiting list of U.S. Pat. Nos. 5,176,996, 5,645,985, 5,650,316, 5,683,874, 5,693,773, 5,834,185, 5,869,246, 5,874,566, and 5,962,426.

External guide sequences (EGSs) are molecules that bind a target nucleic acid molecule forming a complex. This complex is recognized by RNase P, which cleaves the target molecule. EGSs can be designed to specifically target a RNA molecule of choice. RNAse P aids in processing transfer RNA (tRNA) within a cell. Bacterial RNAse P can be recruited to cleave virtually any RNA sequence by using an EGS that causes the target RNA: EGS complex to mimic the natural tRNA substrate. (WO 92/03566 by Yale, and Forster and Altman, *Science* 238:407-409 (1990)).

Similarly, eukaryotic EGS/RNAse P-directed cleavage of RNA can be utilized to cleave desired targets within eukarotic cells. (Yuan et al., *Proc. Natl. Acad. Sci. USA* 89:8006-8010 (1992); WO 93/22434 by Yale; WO 95/24489 by Yale; Yuan and Altman, *EMBO J.* 14:159-168 (1995), and Carrara et al., *Proc. Natl. Acad. Sci.* (USA) 92:2627-2631 (1995)). Representative examples of how to make and use EGS molecules to facilitate cleavage of a variety of different target molecules be found in the following non-limiting list of U.S. Pat. Nos. 5,168,053, 5,624,824, 5,683,873, 5,728,521, 5,869,248, and 5,877,162.

4. Nucleic Acid Delivery

In the methods described above which include the administration and uptake of exogenous DNA into the cells of a subject (i.e., gene transduction or transfection), the disclosed nucleic acids can be in the form of naked DNA or RNA, or the nucleic acids can be in a vector for delivering the nucleic acids to the cells, whereby the antibody-encoding DNA fragment is under the transcriptional regulation of a promoter, as would be well understood by one of ordinary skill in the art. The vector can be a commercially available preparation, such as an adenovirus vector (Quantum Biotechnologies, Inc. (Laval, Quebec, Canada). Delivery of the nucleic acid or vector to cells can be via a variety of mechanisms. As one example, delivery can be via a liposome, using commercially available liposome preparations such as LIPOFECTIN, LIPOFECTAMINE (GIBCO-BRL, Inc., Gaithersburg, Md.), SUPERFECT (Qiagen, Inc. Hilden, Germany) and TRANSFECTAM (Promega Biotec, Inc., Madison, Wis.), as well as other liposomes developed according to procedures standard in the art. In addition, the disclosed nucleic acid or vector can be delivered in vivo by electroporation, the technology for which is available from Genetronics, Inc. (San Diego, Calif.) as well as by means of a SONOPORATION machine (ImaRx Pharmaceutical Corp., Tucson, Ariz.).

As one example, vector delivery can be via a viral system, such as a retroviral vector system which can package a recombinant retroviral genome (see e.g., Pastan et al., *Proc. Natl. Acad. Sci. U.S.A.* 85:4486, 1988; Miller et al., *Mol. Cell. Biol.* 6:2895, 1986). The recombinant retrovirus can then be used to infect and thereby deliver to the infected cells nucleic acid encoding a broadly neutralizing antibody (or active fragment thereof). The exact method of introducing the altered nucleic acid into mammalian cells is, of course, not limited to the use of retroviral vectors. Other techniques are widely available for this procedure including the use of adenoviral vectors (Mitani et al., *Hum. Gene Ther.* 5:941-948, 1994), adeno-associated viral (AAV) vectors (Goodman et al., *Blood* 84:1492-1500, 1994), lentiviral vectors (Naidini et al., *Science* 272:263-267, 1996), pseudotyped retroviral vectors (Agrawal et al., *Exper. Hematol.* 24:738-747, 1996). Physical transduction techniques can also be used, such as liposome delivery and receptor-mediated and other endocytosis mechanisms (see, for example, Schwartzenberger et al., *Blood* 87:472-478, 1996). This disclosed compositions and methods can be used in conjunction with any of these or other commonly used gene transfer methods.

As one example, if the antibody-encoding nucleic acid is delivered to the cells of a subject in an adenovirus vector, the dosage for administration of adenovirus to humans can range from about $10^7$ to $10^9$ plaque forming units (pfa) per injection but can be as high as $10^{12}$ pfu per injection (Crystal, *Hum. Gene Ther.* 8:985-1001, 1997; Alvarez and Curiel, *Hum. Gene Ther.* 8:597-613, 1997). A subject can receive a single injection, or, if additional injections are necessary, they can be repeated at six month intervals (or other appropriate time intervals, as determined by the skilled practitioner) for an indefinite period and/or until the efficacy of the treatment has been established.

Parenteral administration of the nucleic acid or vector, if used, is generally characterized by injection. Injectables can be prepared in conventional forms, either as liquid solutions or suspensions, solid forms suitable for solution of suspension in liquid prior to injection, or as emulsions. A more recently revised approach for parenteral administration involves use of a slow release or sustained release system such that a constant dosage is maintained. See, e.g., U.S. Pat. No. 3,610,795, which is incorporated by reference herein. For additional discussion of suitable formulations and various routes of administration of therapeutic compounds, see, e.g., *Remington: The Science and Practice of Pharmacy* (19th ed.) ed. A. R. Gennaro, Mack Publishing Company, Easton, Pa. 1995.

5. Delivery of the Compositions to Cells

There are a number of compositions and methods which can be used to deliver nucleic acids to cells, either in vitro or in vivo. These methods and compositions can largely be broken down into two classes: viral based delivery systems and non-viral based delivery systems. For example, the nucleic acids can be delivered through a number of direct delivery systems such as, electroporation, lipofection, calcium phosphate precipitation, plasmids, viral vectors, viral nucleic acids, phage nucleic acids, phages, cosmids, or via transfer of genetic material in cells or carriers such as cationic liposomes. Appropriate means for transfection, including viral vectors, chemical transfectants, or physico-mechanical methods such as electroporation and direct diffusion of DNA, are described by, for example, Wolff, J. A., et al., *Science*, 247, 1465-1468, (1990); and Wolff, J. A. *Nature*, 352, 815-818, (1991). Such methods are well known in the art and readily adaptable for use with the compositions and methods described herein. In certain cases, the methods will be modified to specifically function with large DNA molecules. Further, these methods can be used to target certain diseases and cell populations by using the targeting characteristics of the carrier.

Examples of diseases to which the disclosed compositions and methods could directly apply would be severely debilitating diseases, or diseases in which the prognosis is death for example, Alzheimer's, cancer, Grave's disease, Parkinsons, Cystic Fibrosis, Muscular Dystrophy and Diabetes. In the case of any of these diseases, one would use gene delivery techniques to incorporate the receptor into the cells of interest (e.g. delivery to the center of a tumor or delivery into a deteriorated region of tissue). These techniques could include delivery of DNA in the form of a virus (e.g. a retrovirus, lentivirus or adenovirus), a plasmid, naked DNA or in the form of DNA or plasmid conjugated to a TAT peptide. The delivery of the DNA could be performed through catheter based infusion, infusion using a syringe, using a gene gun or any other method which would deliver the DNA directly to the diseased tissue/cells. Sufficient time would then be given for the DNA to be incorporated, and for translation and incorporation of the receptor into the cell membranes to occur. The appropriate contrast agent would be administered and the appropriate modality then used to visualize the diseased tissue, now expressing the receptor. If the appropriate hinge is selected for the receptor allowing for real-time imaging, specific treatment drug compositions could be monitored for efficacy in disease treatment and the appropriate drug prescription for the patient could be administered.

For example, human cancer patient pre-therapeutic drug screening can be performed as follows. A human with a spontaneous tumor requiring treatment, e.g. a brain tumor, can undergo catheter-mediated transfection of a core region of his/her tumor with a plasmid, virus or retrovirus that expressed the chimeric receptor from a non-constitutive promoter that is only active when a certain cell-signaling pathway is active, e.g. the epidermal growth factor signaling pathway. A recycle-promoting cleavable hinge is added to the chimeric receptor to limit the survival of the receptor to minutes, thereby making signal of the receptor directly reflect the minute-to-minute activity of the promoter driving its expression. The efficacy of a serial test doses of different drugs designed to specifically inhibit the cell signaling pathway of interest can be monitored by continuous, real-time monitoring of the chimeric receptor. The rapid "molecular response" of the tumor and its metastases to this sub therapeutic, non-toxic "test doses" serves as a surrogate to tumor regression. Therefore, in a period of 1-4 days the most appropriate treatments with the best chance of response can be pre-selected for the patient.

a) Nucleic Acid Based Delivery Systems

Transfer vectors can be any nucleotide construction used to deliver genes into cells (e.g., a plasmid), or as part of a general strategy to deliver genes, e.g., as part of recombinant retrovirus or adenovirus (Ram et al. *Cancer Res.* 53:83-88, (1993)).

As used herein, plasmid or viral vectors are agents that transport the disclosed nucleic acids, such as a membrane bound protein, into the cell without degradation and include a promoter yielding expression of the gene in the cells into which it is delivered. In some embodiments the vectors are derived from either a virus or a retrovirus. Viral vectors are, for example, Adenovirus, Adeno-associated virus, Herpes virus, Vaccinia virus, Polio virus, AIDS virus, neuronal trophic virus, Sindbis and other RNA viruses, including these viruses with the HIV backbone. Also preferred are any viral families that share the properties of these viruses, making them suitable for use as vectors. Retroviruses include Murine Maloney Leukemia virus, MMLV, and retroviruses that express the desirable properties of MMLV as a vector. Retroviral vectors are able to carry a larger genetic payload, i.e., a transgene or marker gene, than other viral vectors, and for this reason are a commonly used vector. However, they are not as useful in non-proliferating cells. Adenovirus vectors are relatively stable and easy to work with, have high titers, and can be delivered in aerosol formulation, and can transfect non-dividing cells. Pox viral vectors are large and have several sites for inserting genes, they are thermostable and can be stored at room temperature. A preferred embodiment is a viral vector that has been engineered so as to suppress the immune response of the host organism, elicited by the viral antigens. Preferred vectors of this type will carry coding regions for Interleukin 8 or 10.

Viral vectors can have higher transaction (ability to introduce genes) abilities than chemical or physical methods to introduce genes into cells. Typically, viral vectors contain, nonstructural early genes, structural late genes, an RNA polymerase III transcript, inverted terminal repeats necessary for replication and encapsidation, and promoters to control the transcription and replication of the viral genome. When engineered as vectors, viruses typically have one or more of the early genes removed and a gene or gene/promotor cassette is inserted into the viral genome in place of the removed viral DNA. Constructs of this type can cany up to about 8 kb of foreign genetic material. The necessary functions of the removed early genes are typically supplied by cell lines, which have been engineered to express the gene products of the early genes in trans.

(1) Retroviral Vectors

A retrovirus is an animal virus belonging to the virus family of Retroviridae, including any types, subfamilies, genus, or tropisms. Retroviral vectors, in general, are described by Verma, I. M., Retroviral vectors for gene transfer. In Microbiology-1985, American Society for Microbiology, pp. 229-232, Washington, (1985), which is incorporated by reference herein. Examples of methods for using retroviral vectors for gene therapy are described in U.S. Pat. Nos. 4,868,116 and 4,980,286; PCT applications WO 90/02806 and WO 89/07136; and Mulligan, (Science 260:926-932 (1993)); the teachings of which are incorporated herein by reference.

A retrovirus is essentially a package which has packed into it nucleic acid cargo. The nucleic acid cargo carries with it a packaging signal, which ensures that the replicated daughter molecules will be efficiently packaged within the package coat. In addition to the package signal, there are a number of molecules which are needed in cis, for the replication, and packaging of the replicated virus. Typically a retroviral genome, contains the gag, pol, and env genes which are involved in the making of the protein coat. It is the gag, pol, and env genes, which are typically replaced by the foreign DNA that it is to be transferred to the target cell. Retrovirus vectors typically contain a packaging signal for incorporation into the package coat, a sequence which signals the start of the gag transcription unit, elements necessary for reverse transcription, including a primer binding site to bind the tRNA primer of reverse transcription, terminal repeat sequences that guide the switch of RNA strands during DNA synthesis, a purine rich sequence 5' to the 3' LTR that serve as the priming site for the synthesis of the second strand of DNA synthesis, and specific sequences near the ends of the LTRs that enable the insertion of the DNA state of the retrovirus to insert into the host genome. The removal of the gag, pol, and env genes allows for about 8 kb of foreign sequence to be inserted into the viral genome, become reverse transcribed, and upon replication be packaged into a new retroviral particle. This amount of nucleic acid is sufficient for the delivery of a one to many genes depending on the size of each transcript. It is preferable to include either positive or negative selectable markers along with other genes in the insert.

Since the replication machinery and packaging proteins in most retroviral vectors have been removed (gag, pol, and env), the vectors are typically generated by placing them into a packaging cell line. A packaging cell line is a cell line that has been transfected or transformed with a retrovirus that contains the replication and packaging machinery, but lacks any packaging signal. When the vector carrying the DNA of choice is transfected into these cell lines, the vector containing the gene of interest is replicated and packaged into new retroviral particles, by the machinery provided in cis by the helper cell. The genomes for the machinery are not packaged because they lack the necessary signals.

(2) Adenoviral Vectors

The construction of replication-defective adenoviruses has been described (Berkner et al., J. Virology 61:1213-1220 (1987); Massie et al., Mol. Cell. Biol. 6:2872-2883 (1986); Haj-Ahmad et al., J. Virology 57:267-274 (1986); Davidson et al., J. Virology 61:1226-1239 (1987); Zhang "Generation and identification of recombinant adenovirus by liposome-mediated transfection and PCR analysis" BioTechniques 15:868-872 (1993)). The benefit of the use of these viruses as vectors is that they are limited in the extent to which they can spread to other cell types, since they can replicate within an initial infected cell, but are unable to form new infectious viral particles. Recombinant adenoviruses have been shown to achieve high efficiency gene transfer after direct, in vivo delivery to airway epithelium, hepatocytes, vascular endothelium, CNS parenchyma and a number of other tissue sites (Morsy, J. Clin. Invest. 92:1580-1586 (1993); Kirshenbaum, J. Clin. Invest. 92:381-387 (1993); Roessler, J. Clin. Invest. 92:1085-1092 (1993); Moullier, Nature Genetics 4:154-159 (1993); La Salle, Science 259:988-990 (1993); Gomez-Foix, J. Biol. Chem. 267:25129-25134 (1992); Rich, Human Gene Therapy 4:461-476 (1993); Zabner, Nature Genetics 6:75-83 (1994); Guzman, Circulation Research 73:1201-1207 (1993); Bout, Human Gene Therapy 5:3-10 (1994); Zabner, Cell 75:207-216 (1993); Caillaud, Eur. J. Neuroscience 5:1287-1291 (1993); and Ragot, J. Gen. Virology 74:501-507 (1993)). Recombinant adenoviruses achieve gene transduction by binding to specific cell surface receptors, after which the virus is internalized by receptor-mediated endocytosis, in the same manner as wild type or replication-defective adenovirus (Chardonnet and Dales, Virology 40:462-477 (1970); Brown and Burlingham, J. Virology 12:386-396 (1973); Svensson and Persson, J. Virology 55:442-449 (1985); Seth, et al., J. Virol. 51:650-655 (1984); Seth, et al., Mol. Cell. Biol. 4:1528-1533 (1984); Varga et al., J. Virology 65:6061-6070 (1991); Wickham et al., Cell 73:309-319 (1993)).

A viral vector can be one based on an adenovirus which has had the E1 gene removed and these virons are generated in a cell line such as the human 293 cell line. In another preferred embodiment both the E1 and E3 genes are removed from the adenovirus genome.

(3) Adeno-associated Viral Vectors

Another type of viral vector is based on an adeno-associated virus (AAV). This defective parvovirus is a preferred vector because it can infect many cell types and is nonpathogenic to humans. AAV type vectors can transport about 4 to 5 kb and wild type AAV is known to stably insert into chromosome 19. Vectors which contain this site specific integration property are preferred. An especially preferred embodiment of this type of vector is the P4.1 C vector produced by Avigen, San Francisco, Calif., which can contain the herpes simplex virus thymidine kinase gene, HSV-tk, and/or a marker gene, such as the gene encoding the green fluorescent protein, GFP.

In another type of AAV virus, the AAV contains a pair of inverted terminal repeats (ITRs) which flank at least one cassette containing a promoter which directs cell-specific expression operably linked to a heterologous gene. Heterologous in this context refers to any nucleotide sequence or gene that is not native to the AAV or B19 parvovirus.

Typically the AAV and B19 coding regions have been deleted, resulting in a safe, noncytotoxic vector. The AAV ITRs, or modifications thereof, confer infectivity and site-specific integration, but not cytotoxicity, and the promoter directs cell-specific expression. United states Patent No. 6,261,834 is herein incorporated by reference for material related to the AAV vector.

The disclosed vectors thus provide DNA molecules that are capable of integration into a mammalian chromosome without substantial toxicity.

The inserted genes in viral and retroviral usually contain promoters, and/or enhancers to help control the expression of the desired gene product. A promoter is generally a sequence or sequences of DNA that function when in a relatively fixed location in regard to the transcription start site. A promoter contains core elements required for basic interaction of RNA polymerase and transcription factors, and may contain upstream elements and response elements.

(4) Large Payload Viral Vectors

Molecular genetic experiments with large human herpesviruses have provided a means whereby large heterologous DNA fragments can be cloned, propagated and established in cells permissive for infection with herpesviruses (Sun et al., Nature genetics 8: 33-41, 1994; Cotter and Robertson, Curr Opin Mol Ther 5: 633-644, 1999). These large DNA viruses (herpes simplex virus (HSV) and Epstein-Barr virus (EBV), have the potential to deliver fragments of human heterologous DNA >150 kb to specific cells. EBV recombinants can maintain large pieces of DNA in the infected B-cells as episomal DNA. Individual clones carried human genomic inserts up to 330 kb appeared genetically stable The maintenance of these episomes requires a specific EBV nuclear protein, EBNA1, constitutively expressed during infection with EBV. Additionally, these vectors can be used for transfection, where large amounts of protein can be generated transiently in vitro. Herpesvirus amplicon systems are also being used to package pieces of DNA >220 kb and to infect cells that can stably maintain DNA as episomes.

Other useful systems include, for example, replicating and host-restricted non-replicating vaccinia virus vectors.

b) Non-nucleic Acid Based Systems

The disclosed compositions can be delivered to the target cells in a variety of ways. For example, the compositions can be delivered through electroporation, or through lipofection, or through calcium phosphate precipitation. The delivery mechanism chosen will depend in part on the type of cell targeted and whether the delivery is occurring for example in vivo or in vitro.

Thus, the compositions can comprise, in addition to the disclosed vectors, lipids such as liposomes, such as cationic liposomes (e.g., DOTMA, DOPE, DC-cholesterol) or anionic liposomes. Liposomes can further comprise proteins to facilitate targeting a particular cell, if desired. Administration of a composition comprising a compound and a cationic liposome can be administered to the blood afferent to a target organ or inhaled into the respiratory tract to target cells of the respiratory tract. Regarding liposomes, see, e.g., Brigham et al. *Am. J. Resp. Cell. Mol. Biol.* 1:95-100 (1989); Felgner et al. *Proc. Natl. Acad. Sci. USA* 84:7413-7417 (1987); U.S. Pat. No. 4,897,355. Furthermore, the compound can be administered as a component of a microcapsule that can be targeted to specific cell types, such as macrophages, or where the diffusion of the compound or delivery of the compound from the microcapsule is designed for a specific rate or dosage.

In the methods described above which include the administration and uptake of exogenous DNA into the cells of a subject (i.e., gene transduction or transfection), delivery of the compositions to cells can be via a variety of mechanisms. As one example, delivery can be via a liposome, using commercially available liposome preparations such as LIPOFECTIN, LIPOFECTAMINE (GIBCO-BRL, Inc., Gaithersburg, Md.), SUPERFECT (Qiagen, Inc. Hilden, Germany) and TRANSFECTAM (Promega Biotec, Inc., Madison, Wis.), as well as other liposomes developed according to procedures standard in the art. In addition, the disclosed nucleic acid or vector can be delivered in vivo by electroporation, the technology for which is available from Genetronics, Inc. (San Diego, Calif.) as well as by means of a SONOPORATION machine (ImaRx Pharmaceutical Corp., Tucson, Ariz.).

The materials may be in solution, suspension (for example, incorporated into microparticles, liposomes, or cells). These may be targeted to a particular cell type via antibodies, receptors, or receptor ligands. The following references are examples of the use of this technology to target specific proteins to tumor tissue (Senter, et al., *Bioconjugate Chem.*, 2:447-451, (1991); Bagshawe, K. D., *Br. J. Cancer*, 60:275-281, (1989); Bagshawe, et al., *Br. J. Cancer*, 58:700-703, (1988); Senter, et al., *Bioconjugate Chem.*, 4:3-9, (1993); Battelli, et al., *Cancer Immunol. Immunother.*, 35:421-425, (1992); Pietersz and McKenzie, *Immunolog. Reviews*, 129: 57-80, (1992); and Roffler, et al., *Biochem. Pharmacol*, 42:2062-2065, (1991)). These techniques can be used for a variety of other specific cell types. Vehicles such as "stealth" and other antibody conjugated liposomes (including lipid mediated drug targeting to colonic carcinoma), receptor mediated targeting of DNA through cell specific ligands, lymphocyte directed tumor targeting, and highly specific therapeutic retroviral targeting of murine glioma cells in vivo. The following references are examples of the use of this technology to target specific proteins to tumor tissue (Hughes et al., *Cancer Research*, 49:6214-6220, (1989); and Litzinger and Huang, *Biochimica et Biophysica Acta*, 1104:179-187, (1992)). In general, receptors are involved in pathways of endocytosis, either constitutive or ligand induced. These receptors cluster in clathrin-coated pits, enter the cell via clathrin-coated vesicles, pass through an acidified endosome in which the receptors are sorted, and then either recycle to the cell surface, become stored intracellularly, or are degraded in lysosomes. The internalization pathways serve a variety of functions, such as nutrient uptake, removal of activated proteins, clearance of macromolecules, opportunistic entry of viruses and toxins, dissociation and degradation of ligand, and receptor-level regulation. Many receptors follow more than one intracellular pathway, depending on the cell type, receptor concentration, type of ligand, ligand valency, and ligand concentration. Molecular and cellular mechanisms of receptor-mediated endocytosis has been reviewed (Brown and Greene, *DNA and Cell Biology* 10:6, 399-409 (1991)).

Nucleic acids that are delivered to cells, which are to be integrated into the host cell genome, typically contain integration sequences. These sequences are often viral related sequences, particularly when viral based systems are used. These viral intergration systems can also be incorporated into nucleic acids which are to be delivered using a non-nucleic acid based system of deliver, such as a liposome, so that the nucleic acid contained in the delivery system can be come integrated into the host genome.

Other general techniques for integration into the host genome include, for example, systems designed to promote homologous recombination with the host genome. These systems typically rely on sequence flanking the nucleic acid to be expressed that has enough homology with a target sequence within the host cell genome that recombination between the vector nucleic acid and the target nucleic acid takes place, causing the delivered nucleic acid to be integrated into the host genome. These systems and the methods necessary to promote homologous recombination are known to those of skill in the art.

c) In vivo/Ex vivo

As described above, the compositions can be administered in a pharmaceutically acceptable carrier and can be delivered to the subject=s cells in vivo and/or ex vivo by a variety of mechanisms well known in the art (e.g., uptake of naked DNA, liposome fusion, intramuscular injection of DNA via a gene gun, endocytosis and the like).

If ex vivo methods are employed, cells or tissues can be removed and maintained outside the body according to standard protocols well known in the art. The compositions can be introduced into the cells via any gene transfer mechanism, such as, for example, calcium phosphate mediated gene delivery, electroporation, microinjection or proteoliposomes. The transduced cells can then be infused (e.g., in a pharmaceutically acceptable carrier) or homotopically transplanted back into the subject per standard methods for the cell or tissue type. Standard methods are known for transplantation or infusion of various cells into a subject.

6. Expression Systems

The nucleic acids that are delivered to cells typically contain expression controlling systems. For example, the inserted genes in viral and retroviral systems usually contain promoters, and/or enhancers to help control the expression of the desired gene product. A promoter is generally a sequence or sequences of DNA that function when in a relatively fixed location in regard to the transcription start site. A promoter contains core elements required for basic interaction of RNA polymerase and transcription factors, and may contain upstream elements and response elements.

a) Viral Promoters and Enhancers

Preferred promoters controlling transcription from vectors in mammalian host cells maybe obtained from various sources, for example, the genomes of viruses such as: polyoma, Simian Virus 40 (SV40), adenovirus, retroviruses, hepatitis-B virus and most preferably cytomegalovirus, or from heterologous mammalian promoters, e.g. beta actin promoter. The early and late promoters of the SV40 virus are conveniently obtained as an SV40 restriction fragment which also contains the SV40 viral origin of replication (Fiers et al., *Nature*, 273: 113 (1978)). The immediate early promoter of the human cytomegalovirus is conveniently obtained as a HindIII E restriction fragment (Greenway, P. J. et al., *Gene* 18: 355-360 (1982)). Of course, promoters from the host cell or related species also are useful herein.

Enhancer generally refers to a sequence of DNA that functions at no fixed distance from the transcription start site and can be either 5' (Laimins, L. et al., *Proc. Natl. Acad. Sci.* 78: 993 (1981)) or 3' (Lusky, M. L., et al., *Mol. Cell Bio.* 3: 1108 (1983)) to the transcription unit. Furthermore, enhancers can be within an intron (Banerji, J. L. et al., *Cell* 33: 729 (1983)) as well as within the coding sequence itself (Osborne, T. F., et al., *Mol. Cell Bio.* 4: 1293 (1984)). They are usually between 10 and 300 bp in length, and they function in cis. Enhancers function to increase transcription from nearby promoters. Enhancers also often contain response elements that mediate the regulation of transcription. Promoters can also contain response elements that mediate the regulation of transcription. Enhancers often determine the regulation of expression of a gene. While many enhancer sequences are now known from mammalian genes (globin, elastase, albumin, -fetoprotein and insulin), typically one will use an enhancer from a eukaryotic cell virus for general expression. Preferred examples are the SV40 enhancer on the late side of the replication origin (bp 100-270), the cytomegalovirus early promoter enhancer, the polyoma enhancer on the late side of the replication origin, and adenovirus enhancers.

The promotor and/or enhancer may be specifically activated either by light or specific chemical events that trigger their function. Systems can be regulated by reagents such as tetracycline and dexamethasone. There are also ways to enhance viral vector gene expression by exposure to irradiation, such as gamma irradiation, or alkylating chemotherapy drugs.

In certain embodiments the promoter and/or enhancer region can act as a constitutive promoter and/or enhancer to maximize expression of the region of the transcription unit to be transcribed. In certain constructs the promoter and/or enhancer region be active in all eukaryotic cell types, even if it is only expressed in a particular type of cell at a particular time. A preferred promoter of this type is the CMV promoter (650 bases). Other preferred promoters are SV40 promoters, cytomegalovirus (full length promoter), and retroviral vector LTF.

It has been shown that all specific regulatory elements can be cloned and used to construct expression vectors that are selectively expressed in specific cell types such as melanoma cells. The glial fibrillary acetic protein (GFAP) promoter has been used to selectively express genes in cells of glial origin.

Expression vectors used in eukaryotic host cells (yeast, fungi, insect, plant, animal, human or nucleated cells) may also contain sequences necessary for the termination of transcription, which may affect mRNA expression. These regions are transcribed as polyadenylated segments in the untranslated portion of the mRNA encoding tissue factor protein. The 3' untranslated regions also include transcription termination sites. It is preferred that the transcription unit also contain a polyadenylation region. One benefit of this region is that it increases the likelihood that the transcribed unit will be processed and transported like mRNA. The identification and use of polyadenylation signals in expression constructs is well established. It is preferred that homologous polyadenylation signals be used in the transgene constructs. In certain transcription units, the polyadenylation region is derived from the SV40 early polyadenylation signal and consists of about 400 bases. It is also preferred that the transcribed units contain other standard sequences alone or in combination with the above sequences improve expression from, or stability of, the construct.

b) Markers

The viral vectors can include nucleic acid sequence encoding a marker product. This marker product is used to determine if the gene has been delivered to the cell and once delivered is being expressed. Preferred marker genes are the *E. Coli* lacZ gene, which encodes β-galactosidase, and green fluorescent protein.

In some embodiments the marker may be a selectable marker. Examples of suitable selectable markers for mammalian cells are dihydrofolate reductase (DHFR), thymidine kinase, neomycin, neomycin analog G418, hydromycin, and puromycin. When such selectable markers are successfully transferred into a mammalian host cell, the transformed mammalian host cell can survive if placed under selective pressure. There are two widely used distinct categories of selective regimes. The first category is based on a cell's metabolism and the use of a mutant cell line that lacks the ability to grow independent of a supplemented media. Two examples are: CHO DHFR-cells and mouse LTK-cells. These cells lack the ability to grow without the addition of such nutrients as thymidine or hypoxanthine. Because these cells lack certain genes necessary for a complete nucleotide synthesis pathway, they cannot survive unless the missing nucleotides are provided in a supplemented media. An alternative to supplementing the media is to introduce an intact DHFR or TK gene into cells lacking the respective genes, thus altering their growth requirements. Individual cells that were not transformed with the DHFR or TK gene will not be capable of survival in non-supplemented media.

The second category is dominant selection which refers to a selection scheme used in any cell type and does not require the use of a mutant cell line. These schemes typically use a drug to arrest growth of a host cell. Those cells that have a novel gene would express a protein conveying drug resistance and would survive the selection. Examples of such dominant selection use the drugs neomycin, (Southern P. and Berg, P., *J. Molec. Appl. Genet.* 1: 327 (1982)), mycophenolic acid, (Mulligan, R. C. and Berg, P. *Science* 209: 1422 (1980)) or hygromycin, (Sugden, B. et al., *Mol. Cell. Biol.* 5: 410-413 (1985)). The three examples employ bacterial genes under eukaryotic control to convey resistance to the appropriate drug G418 or neomycin (geneticin), xgpt (mycophenolic acid) or hygromycin, respectively. Others include the neomycin analog G418 and puramycin.

7. Peptides a) Protein Variants

As discussed herein there are numerous variants of the maltose binding protein, for example, which are known and herein contemplated. In addition, to the known functional maltose binding protein strain variants there are derivatives of these proteins which also function in the disclosed methods and compositions. Protein variants and derivatives are well understood to those of skill in the art and in can involve amino acid sequence modifications. For example, amino acid sequence modifications typically fall into one or more of three classes: substitutional, insertional or deletional variants. Insertions include amino and/or carboxyl terminal fusions as well as intrasequence insertions of single or multiple amino acid residues. Insertions ordinarily will be smaller insertions than those of amino or carboxyl terminal fusions, for example, on the order of one to four residues. Immunogenic fusion protein derivatives, such as those described in the examples, are made by fusing a polypeptide sufficiently large to confer immunogenicity to the target sequence by cross-linking in vitro or by recombinant cell culture transformed with DNA encoding the fusion. Deletions are characterized by the removal of one or more amino acid residues from the protein sequence. Typically, no more than about from 2 to 6 residues are deleted at any one site within the protein molecule. These variants ordinarily are prepared by site specific mutagenesis of nucleotides in the DNA encoding the protein, thereby producing DNA encoding the variant, and thereafter expressing the DNA in recombinant cell culture. Techniques for making substitution mutations at predetermined sites in DNA having a known sequence are well known, for example M13 primer mutagenesis and PCR mutagenesis. Amino acid substitutions are typically of single residues, but can occur at a number of different locations at once; insertions usually will be on the order of about from 1 to 10 amino acid residues; and deletions will range about from 1 to 30 residues. Deletions or insertions preferably are made in adjacent pairs, i.e. a deletion of 2 residues or insertion of 2 residues. Substitutions, deletions, insertions or any combination thereof may be combined to arrive at a final construct. The mutations must not place the sequence out of reading frame and preferably will not create complementary regions that could produce secondary mRNA structure. Substitutional variants are those in which at least one residue has been removed and a different residue inserted in its place. Such substitutions generally are made in accordance with the following Tables 6 and 7 and are referred to as conservative substitutions.

TABLE 5

Amino Acid Abbreviations

| Amino Acid | Abbreviations |
|---|---|
| Alanine | AlaA |
| Allosoleucine | AIle |
| Arginine | ArgR |
| Asparagine | AsnN |
| aspartic acid | AspD |
| Cysteine | CysC |
| glutamic acid | GluE |
| Glutamine | GlnK |
| Glycine | GlyG |
| Histidine | HisH |
| Isolelucine | IleI |
| Leucine | LeuL |
| Lysine | LysK |
| Phenylalanine | PheF |
| Proline | ProP |
| pyroglutamic acid | Glu |
| Serine | SerS |
| Threonine | ThrT |
| Tyrosine | TyrY |
| Tryptophan | TrpW |
| Valine | ValV |

TABLE 6

Amino Acid Substitutions
Original Residue Exemplary Conservative Substitutions,
others are known in the art.

Ala/ser
Arg/lys, gln
Asn/gln; his
Asp/glu
Cys/ser
Gln/asn, lys
Glu/asp
Gly/pro
His/asn; gln
Ile/leu; val
Leu/ile; val
Lys/arg; gln;
Met/Leu; ile
Phe/met; leu; tyr
Ser/thr
Thr/ser
Trp/tyr
Tyr/trp; phe
Val/ile; leu Substantial changes in function or immunological identity are made by selecting substitutions that are less conservative than those in Table 6, i.e., selecting residues that differ more significantly in their effect on maintaining (a) the structure of the polypeptide backbone in the area of the substitution, for example as a sheet or helical conformation, (b) the charge or hydrophobicity of the molecule at the target site or (c) the bulk of the side chain. The substitutions which in general are expected to produce the greatest changes in the protein properties will be those in which (a) a hydrophilic residue, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine, in this case, (e) by increasing the number of sites for sulfation and/or glycosylation.

For example, the replacement of one amino acid residue with another that is biologically and/or chemically similar is known to those skilled in the art as a conservative substitution. For example, a conservative substitution would be replacing one hydrophobic residue for another, or one polar residue for another. The substitutions include combinations such as, for example, Gly, Ala; Val, Ile, Leu; Asp, Glu; Asn, Gln; Ser, Thr; Lys, Arg; and Phe, Tyr. Such conservatively substituted variations of each explicitly disclosed sequence are included within the mosaic polypeptides provided herein.

Substitutional or deletional mutagenesis can be employed to insert sites for N-glycosylation (Asn-X-Thr/Ser) or O-glycosylation (Ser or Thr). Deletions of cysteine or other labile residues also may be desirable. Deletions or substitutions of potential proteolysis sites, e.g. Arg, are accomplished for example by deleting one of the basic residues or substituting one by glutaminyl or histidyl residues.

Certain post-translational derivatizations are the result of the action of recombinant host cells on the expressed polypeptide. Glutaminyl and asparaginyl residues are frequently post-translationally deamidated to the corresponding glutamyl and asparyl residues. Alternatively, these residues are deamidated under mildly acidic conditions. Other post-translational modifications include hydroxylation of proline and lysine, phosphorylation of hydroxyl groups of seryl or threonyl residues, methylation of the o-amino groups of lysine, arginine, and histidine side chains (T. E. Creighton, Proteins: Structure and Molecular Properties, W. H. Freeman & Co., San Francisco pp 79-86 [1983]), acetylation of the N-terminal amine and, in some instances, amidation of the C-terminal carboxyl.

It is understood that one way to define the variants and derivatives of the disclosed proteins herein is through defining the variants and derivatives in terms of homology/identity to specific known sequences. For example, SEQ ID NO:1 sets forth a particular sequence of maltose binding protein and SEQ ID NO:15 sets forth a particular sequence of another maltose binding protein. Specifically disclosed are variants of these and other proteins herein disclosed which have at least, 70% or 75% or 80% or 85% or 90% or 95% homology to the stated sequence. Those of skill in the art readily understand how to determine the homology of two proteins. For example, the homology can be calculated after aligning the two sequences so that the homology is at its highest level.

Another way of calculating homology can be performed by published algorithms. Optimal alignment of sequences for comparison may be conducted by the local homology algorithm of Smith and Waterman Adv. Appl. Math. 2: 482 (1981), by the homology alignment algorithm of Needleman and Wunsch, J. Mol. Biol. 48: 443 (1970), by the search for similarity method of Pearson and Lipman, Proc. Natl. Acad. Sci. U.S.A. 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The same types of homology can be obtained for nucleic acids by for example the algorithms disclosed in Zuker, M. Science 244:48-52, 1989, Jaeger et al. Proc. Natl. Acad. Sci. USA 86:7706-7710, 1989, Jaeger et al. Methods Enzymol. 183:281-306, 1989 which are herein incorporated by reference for at least material related to nucleic acid alignment.

It is understood that the description of conservative mutations and homology can be combined together in any combination, such as embodiments that have at least 70% homology to a particular sequence wherein the variants are conservative mutations.

As this specification discusses various proteins and protein sequences it is understood that the nucleic acids that can encode those protein sequences are also disclosed. This would include all degenerate sequences related to a specific protein sequence, i.e. all nucleic acids having a sequence that encodes one particular protein sequence as well as all nucleic acids, including degenerate nucleic acids, encoding the disclosed variants and derivatives of the protein sequences. Thus, while each particular nucleic acid sequence may not be written out herein, it is understood that each and every sequence is in fact disclosed and described herein through the disclosed protein sequence. For example, one of the many nucleic acid sequences that can encode the protein sequence set forth in SEQ ID NO: 2 is set forth in SEQ ID NO:2. It is also understood that while no amino acid sequence indicates what particular DNA sequence encodes that protein within an organism, where particular variants of a disclosed protein are disclosed herein, the known nucleic acid sequence that encodes that protein in the particular pathway from which that protein arises is also known and herein disclosed and described.

It is understood that there are numerous amino acid and peptide analogs which can be incorporated into the disclosed compositions. For example, there are numerous D amino acids or amino acids, which have a different functional substituent then the amino acids shown in Table 5 and Table 6. The opposite stereoisomers of naturally occurring peptides are disclosed, as well as the stereo isomers of peptide analogs. These amino acids can readily be incorporated into polypeptide chains by charging tRNA molecules with the amino acid of choice and engineering genetic constructs that utilize, for example, amber codons, to insert the analog amino acid into a peptide chain in a site specific way (Thorson et al., Methods in Molec. Biol. 77:43-73 (1991), Zoller, Current Opinion in Biotechnology, 3:348-354 (1992); Ibba, Biotechnology & Genetic Engineering Reviews 13:197-216 (1995), Cahill et al., TIBS, 14(10):400-403 (1989); Benner, TIB Tech, 12:158-163 (1994); Ibba and Hennecke, Bio/technology, 12:678-682 (1994) all of which are herein incorporated by reference at least for material related to amino acid analogs).

Molecules can be produced that resemble peptides, but which are not connected via a natural peptide linkage. For example, linkages for amino acids or amino acid analogs can include $CH_2NH$—, —$CH_2S$—, —$CH_2$—$CH_2$—, —CH═CH—(cis and trans), —$COCH_2$—, —CH(OH) $CH_2$—, and —$CHH_2SO$— (These and others can be found in Spatola, A. F. in Chemistry and Biochemistry of Amino Acids, Peptides, and Proteins, B. Weinstein, eds., Marcel Dekker, New York, p. 267 (1983); Spatola, A. F., Vega Data (March 1983), Vol. 1, Issue 3, Peptide Backbone Modifications (general review); Morley, Trends Pharm Sci (1980) pp. 463-468; Hudson, D. et al., Int J Pept Prot Res 14:177-185 (1979) (—$CH_2NH$—, $CH_2CH_2$—); Spatola et al. Life Sci 38:1243-1249 (1986) (—CH H$_2$—S); Hann J. Chem. Soc Perkin Trans. 1307-314 (1982) (—CH—CH—, cis and trans); Almquist et al. J. Med. Chem. 23:1392-1398 (1980) (—COCH$_2$—); Jennings-White et al. Tetrahedron Lett 23:2533 (1982) (—COCH$_2$—); Szelke et al. European Appln, EP 45665 CA (1982): 97:39405 (1982) (—CH(OH)CH$_2$—); Holladay et al. Tetrahedron. Lett 24:4401-4404 (1983) (—C (OH)CH$_2$—); and Hruby Life Sci 31:189-199 (1982) (—CH$_2$—S—); each of which is incorporated herein by reference. A particularly preferred non-peptide linkage is —CH$_2$NH—. It is understood that peptide analogs can have more than one atom between the bond atoms, such as b-alanine, g-aminobutyric acid, and the like.

Amino acid analogs and analogs and peptide analogs often have enhanced or desirable properties, such as, more economical production, greater chemical stability, enhanced pharmacological properties (half-life, absorption, potency, efficacy, etc.), altered specificity (e.g., a broad-spectrum of biological activities), reduced antigenicity, and others.

D-amino acids can be used to generate more stable peptides, because D amino acids are not recognized by peptidases and such. Systematic substitution of one or more amino acids of a consensus sequence with a D-amino acid of the same type (e.g., D-lysine in place of L-lysine) can be used to generate more stable peptides. Cysteine residues can be used to cyclize or attach two or more peptides together. This can be beneficial to constrain peptides into particular conformations. (Rizo and Gierasch Ann. Rev. Biochem. 61:387 (1992), incorporated herein by reference).

b) Directed Evolution

Directed evolution is a method wherein one takes a family of genes and randomly combines different regions of these genes in order to make novel genes. The products of these new genes are then screened for a desired increase (or decrease) in function or for new desired functions. See: Hult K, Berglund P: Engineered enzymes for improved organic synthesis. Curr Opin Biotechnol 2003, 14:395-400. This technology could be applied to the different regions of the hinge resulting in increased expression of the hinge in the membrane, increased binding affinity between the receptor and substrate or better hinge pharmacokinetics.

c) Codon Optimization

Amino acids are encoded by triples of DNA sequences called codons, such as ggc or cgt. Many of these amino acids are encoded by several different codons. Each of these codons has a specific tRNA which recognizes and has the specific amino acid corresponding to the codon sequence attached to it. Different organisms use these codons to varying degrees. For example one organism will use a specific codon more frequently than others to encode a specific amino acid. For example alanine is encoded by the codons gct, gcc, gca and gcg and this organism may prefer to encode alanine most of the time by gct. Another organism might use a different codon to encode the same amino acid, alanine, for example using gca. Applying this across all codons one can see how there can exist a large degree of variability among organisms as to which codons are more frequently used. Organisms using tRNA's corresponding to codons of high usage will produce more of these tRNA's and less of the tRNA's corresponding to codons with less usage. This can lead to problems in expression efficiency when a gene from a very different organism is expressed in another organism, for example expressing a bacterial gene in a mammal. Codon optimization minimizes this problem and optimizes gene expression by converting the gene sequence from the organism of interest (in which the codons are utilized very differently) into a different gene sequence, which still encodes the same amino acid sequence but uses codons similar to the way the organism into which the gene is expressed uses them. This minimizes problems associated with codon usage differences between organisms and enhances protein expression.

8. Antibodies (1) Antibodies Generally

There are numerous proteins that can be used with the methods disclosed herein which are recognized by specific antibodies. Antibodies are well characterized and are known for their capability to bind with high affinity (up to $K_d$=10-20×10$^9$) to a very specific ligand. Also included in the term are "minibodies" and "diabodies." (Sundarasan, J Nucl Med. 2003 December; 44(12):1962-9, herein included in its entirety for the teaching of minibodies and diabodies as related to molecular imaging.) The term "antibodies" is used herein in a broad sense and includes both polyclonal and monoclonal antibodies. In addition to intact immunoglobulin molecules, also included in the term "antibodies" are fragments or polymers of those immunoglobulin molecules, and human or humanized versions of immunoglobulin molecules or fragments thereof, as long as they are chosen for their ability to interact with, for example, maltose binding protein, such that maltose is inhibited from interacting with maltose binding protein. The antibodies can be tested for their desired activity using the in vitro assays described herein, or by analogous methods, after which their in vivo therapeutic and/or prophylactic activities are tested according to known clinical testing methods.

The term "monoclonal antibody" as used herein refers to an antibody obtained from a substantially homogeneous population of antibodies, i.e., the individual antibodies within the population are identical except for possible naturally occurring mutations that may be present in a small subset of the antibody molecules. The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, as long as they exhibit the desired antagonistic activity (See, U.S. Pat. No. 4,816,567 and Morrison et al., *Proc. Natl. Acad. Sci. USA,* 81:6851-6855 (1984)).

The disclosed monoclonal antibodies can be made using any procedure, which produces monoclonal antibodies. For example, disclosed monoclonal antibodies can be prepared using hybridoma methods, such as those described by Kohler and Milstein, *Nature,* 256:495 (1975). In a hybridoma method, a mouse or other appropriate host animal is typically immunized with an immunizing agent to elicit lymphocytes that produce or are capable of producing antibodies that will specifically bind to the immunizing agent. Alternatively, the lymphocytes may be immunized in vitro, e.g., using the HIV Env-CD4-co-receptor complexes described herein.

The monoclonal antibodies may also be made by recombinant DNA methods, such as those described in U.S. Pat. No. 4,816,567 (Cabilly et al.). DNA encoding the disclosed monoclonal antibodies can be readily isolated and sequenced using conventional procedures (e.g., by using oligonucleotide probes that are capable of binding specifically to genes encoding the heavy and light chains of murine antibodies). Libraries of antibodies or active antibody fragments can also be generated and screened using phage display techniques, e.g., as described in U.S. Pat. No. 5,804,440 to Burton et al. and U.S. Pat. No. 6,096,441 to Barbas et al.

In vitro methods are also suitable for preparing monovalent antibodies. Digestion of antibodies to produce fragments thereof, particularly, Fab fragments, can be accomplished using routine techniques known in the art. For instance, digestion can be performed using papain. Examples of papain digestion are described in WO 94/29348 published Dec. 22, 1994 and U.S. Pat. No. 4,342,566. Papain digestion of antibodies typically produces two identical antigen binding fragments, called Fab fragments, each with a single antigen binding site, and a residual Fc fragment. Pepsin treatment yields a fragment that has two antigen combining sites and is still capable of cross-linking antigen.

The fragments, whether attached to other sequences or not, can also include insertions, deletions, substitutions, or other selected modifications of particular regions or specific amino acids residues, provided the activity of the antibody or antibody fragment is not significantly altered or impaired compared to the non-modified antibody or antibody fragment. These modifications can provide for some additional property, such as to remove/add amino acids capable of disulfide bonding, to increase its bio-longevity, to alter its secretory characteristics, etc. In any case, the antibody or antibody fragment must possess a bioactive property, such as specific binding to its cognate antigen. Functional or active regions of the antibody or antibody fragment may be identified by mutagenesis of a specific region of the protein, followed by expression and testing of the expressed polypeptide. Such methods are readily apparent to a skilled practitioner in the art and can include site-specific mutagenesis of the nucleic acid encoding the antibody or antibody fragment. (Zoller, M. J. *Curr. Opin. Biotechnol.* 3:348-354, 1992).

As used herein, the term "antibody" or "antibodies" can also refer to a human antibody and/or a humanized antibody. Many non-human antibodies (e.g., those derived from mice, rats, or rabbits) are naturally antigenic in humans, and thus can give rise to undesirable immune responses when administered to humans. Therefore, the use of human or humanized antibodies in the methods serves to lessen the chance that an antibody administered to a human will evoke an undesirable immune response.

(2) Human Antibodies

The disclosed human antibodies can be prepared using any technique. Examples of techniques for human monoclonal antibody production include those described by Cole et al. (*Monoclonal Antibodies and Cancer Therapy*, Alan R. Liss, p. 77, 1985) and by Boerner et al. (*J. Immunol.*, 147(1):86-95, 1991). Human antibodies (and fragments thereof) can also be produced using phage display libraries (Hoogenboom et al., *J. Mol. Biol.*, 227:381, 1991; Marks et al., *J. Mol. Biol.*, 222:581, 1991).

The disclosed human antibodies can also be obtained from transgenic animals. For example, transgenic, mutant mice that are capable of producing a full repertoire of human antibodies, in response to immunization, have been described (see, e.g., Jakobovits et al., *Proc. Natl. Acad. Sci. USA*, 90:2551-255 (1993); Jakobovits et al., *Nature*, 362:255-258 (1993); Bruggermann et al., *Year in Immunol.*, 7:33 (1993)). Specifically, the homozygous deletion of the antibody heavy chain joining region (J(H)) gene in these chimeric and germ-line mutant mice results in complete inhibition of endogenous antibody production, and the successful transfer of the human germ-line antibody gene array into such germ-line mutant mice results in the production of human antibodies upon antigen challenge. Antibodies having the desired activity are selected using Env-CD4-co-receptor complexes as described herein.

(3) Humanized Antibodies

Antibody humanization techniques generally involve the use of recombinant DNA technology to manipulate the DNA sequence encoding one or more polypeptide chains of an antibody molecule. Accordingly, a humanized form of a non-human antibody (or a fragment thereof) is a chimeric antibody or antibody chain (or a fragment thereof, such as an Fv, Fab, Fab', or other antigen-binding portion of an antibody) which contains a portion of an antigen binding site from a non-human (donor) antibody integrated into the framework of a human (recipient) antibody.

To generate a humanized antibody, residues from one or more complementarity determining regions (CDRs) of a recipient (human) antibody molecule are replaced by residues from one or more CDRs of a donor (non-human) antibody molecule that is known to have desired antigen binding characteristics (e.g., a certain level of specificity and affinity for the target antigen). In some instances, Fv framework (FR) residues of the human antibody are replaced by corresponding non-human residues. Humanized antibodies may also contain residues which are found neither in the recipient antibody nor in the imported CDR or framework sequences. Generally, a humanized antibody has one or more amino acid residues introduced into it from a source which is non-human. In practice, humanized antibodies are typically human antibodies in which some CDR residues and possibly some FR residues are substituted by residues from analogous sites in rodent antibodies. Humanized antibodies generally contain at least a portion of an antibody constant region (Fc), typically that of a human antibody (Jones et al., *Nature,* 321:522-525 (1986), Reichmann et al., *Nature,* 332:323-327 (1988), and Presta, *Curr. Opin. Struct. Biol.,* 2:593-596 (1992)).

Methods for humanizing non-human antibodies are well known in the art. For example, humanized antibodies can be generated according to the methods of Winter and co-workers (Jones et al., *Nature,* 321:522-525 (1986), Riechmann et al., *Nature,* 332:323-327 (1988), Verhoeyen et al., *Science,* 239: 1534-1536 (1988)), by substituting rodent CDRs or CDR sequences for the corresponding sequences of a human antibody. Methods that can be used to produce humanized antibodies are also described in U.S. Pat. No. 4,816,567 (Cabilly et al.), U.S. Pat. No. 5,565,332 (Hoogenboom et al.), U.S. Pat. No. 5,721,367 (Kay et al.), U.S. Pat. No. 5,837,243 (Deo et al.), U.S. Pat. No. 5,939,598 (Kucherlapati et al.), U.S. Pat. No. 6,130,364 (Jakobovits et al.), and U.S. Pat. No. 6,180,377 (Morgan et al.).

(4) Minibodies and Diabodies

Minibodies and Diabodies are portions of antibodies containing the recognition region (variable regions) of the antibody. Since these portions contain this recognition region of the antibody they can be tagged and essentially be used the same as regular antibodies.

(5) Administration of Antibodies

Administration of the antibodies can be done as disclosed herein. Nucleic acid approaches for antibody delivery also exist. The broadly neutralizing anti maltose binding protein antibodies and antibody fragments can also be administered to patients or subjects as a nucleic acid preparation (e.g., DNA or RNA) that encodes the antibody or antibody fragment, such that the patient's or subject's own cells take up the nucleic acid and produce and secrete the encoded antibody or antibody fragment. The delivery of the nucleic acid can be by any means, as disclosed herein, for example.

9. Kits

Disclosed herein are kits that are drawn to reagents that can be used in practicing the methods disclosed herein. The kits can include any reagent or combination of reagent discussed herein or that would be understood to be required or beneficial in the practice of the disclosed methods. For example, the kits could include vectors as well as reporters. For example, disclosed is a kit for assessing a subject's risk for acquiring prostate cancer, comprising the vector set forth in SEQ ID NO: 1.

D. Methods of Making the Compositions

The compositions disclosed herein and the compositions necessary to perform the disclosed methods can be made using any method known to those of skill in the art for that particular reagent or compound unless otherwise specifically noted.

1. Nucleic Acid Synthesis

For example, the nucleic acids, such as, the vectors to be used as vectors can be made using standard chemical synthesis methods or can be produced using enzymatic methods or any other known method. Such methods can range from standard enzymatic digestion followed by nucleotide fragment isolation (see for example, Sambrook et al., *Molecular Cloning: A Laboratory Manual,* 2nd Edition (Cold Spring Harbor Laboratory Press, Cold Spring Harbor, N.Y., 1989) Chapters 5, 6) to purely synthetic methods, for example, by the cyanoethyl phosphoramidite method using a Milligen or Beckman System 1Plus DNA synthesizer (for example, Model 8700 automated synthesizer of Milligen-Biosearch, Burlington, Mass. or ABI Model 380B). Synthetic methods useful for making oligonucleotides are also described by Ikuta et al., *Ann. Rev. Biochem.* 53:323-356 (1984), (phosphotriester and phosphite-triester methods), and Narang et al., *Methods Enzymol.,* 65:610-620 (1980), (phosphotriester method). Protein nucleic acid molecules can be made using known methods such as those described by Nielsen et al., *Bioconjug. Chem.* 5:3-7 (1994).

2. Methods of Gene Modification and Gene Disruption

The disclosed compositions and methods can be used for targeted gene disruption and modification in any animal that can undergo these events. Gene modification and gene disruption refer to the methods, techniques, and compositions that surround the selective removal or alteration of a gene or stretch of chromosome in an animal, such as a mammal, in a way that propagates the modification through the germ line of the mammal. In general, a cell is transformed with a vector which is designed to homologously recombine with a region of a particular chromosome contained within the cell, as for example, described herein. This homologous recombination event can produce a chromosome which has exogenous DNA introduced, for example in frame, with the surrounding DNA. This type of protocol allows for very specific mutations, such as point mutations, to be introduced into the genome contained within the cell. Methods for performing this type of homologous recombination are disclosed herein.

One of the preferred characteristics of performing homologous recombination in mammalian cells is that the cells should be able to be cultured, because the desired recombination event occurs at a low frequency.

Once the cell is produced through the methods described herein, an animal can be produced from this cell through either stem cell technology or cloning technology. For example, if the cell into which the nucleic acid was transfected was a stem cell for the organism, then this cell, after transfection and culturing, can be used to produce an organism which will contain the gene modification or disruption in germ line cells, which can then in turn be used to produce another animal that possesses the gene modification or disruption in all of its cells. In other methods for production of an animal containing the gene modification or disruption in all of its cells, cloning technologies can be used. These technologies generally take the nucleus of the transfected cell and either through fusion or replacement, fuse the transfected nucleus with an oocyte, which can then be manipulated to produce an animal. The advantage of procedures that use cloning instead of ES technology is that cells other than ES cells can be transfected. For example, a fibroblast cell, which is very easy to culture, can be used as the cell which is transfected and has a gene modification or disruption event take place, and then cells derived from this cell can be used to clone a whole animal.

E. Examples

The following examples are put forth so as to provide those of ordinary skill in the art with a complete disclosure and description of how the compounds, compositions, articles, devices and/or methods claimed herein are made and evaluated, and are intended to be purely exemplary and are not intended to limit the disclosure. Efforts have been made to ensure accuracy with respect to numbers (e.g., amounts, temperature, etc.), but some errors and deviations should be accounted for. Unless indicated otherwise, parts are parts by weight, temperature is in ° C. or is at ambient temperature, and pressure is at or near atmospheric.

1. Example 1

Targeting Vectors

Figure 2:
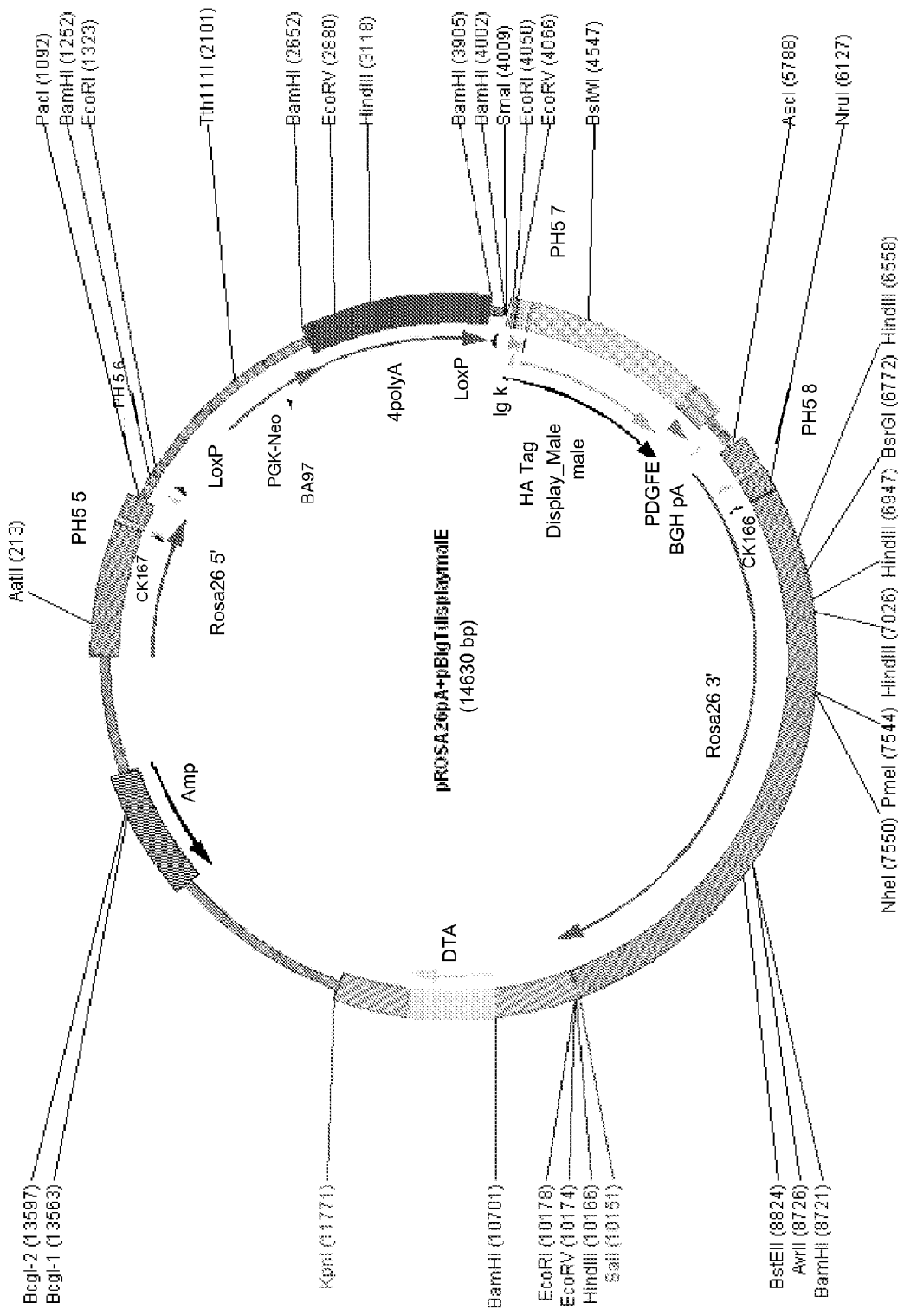
FIG. 2 shows the final targeting vector construct used for electroporation into mouse embryonic stem cells. Correct targeting of this vector and subsequent integration of cloned DNA into the mouse allows for conditional expression of maltose binding protein on the extracellular side of the cell membrane in cells or tissue determined by the location of Cre expression.

A targeting vector was cloned that includes the following features: the chimeric protein was created using the pDisplay vector from Invitrogen (Carlsbad, Calif.) and was composed of the following: an Ig-k leader sequence signal peptide allowing for expression of the protein of interest on the extracellular side of cells through targeting of protein to the secretory pathway, a hemagglutinin A epitope for antibody labeling, maltose binding protein (MalE) cDNA for expression of maltose binding protein (obtained by a PCR reaction using pMal from New England Biolabs (Beverly, Mass.)), a myc epitope for additional antibody labeling, the PDGFR transmembrane domain for anchoring maltose binding protein to the cell membrane, and a bovine growth hormone poly-adenylation sequence to stop protein translation. Conditional, strong expression of this reporter transgene from the ROSA26 locus (for use with cre-mediated recombination) was accomplished by inserting this transgene reporter into the ROSA26 reporter using the previously described Rosa26pA BigT system by Srinivas et al. This allowed for expression of the reporter transgene at a location and time defined by the expression of Cre driven by any gene or promoter. FIG. 2 shows a map of this targeting vector.

2. Example 2

Mouse Embryonic Stem Cells

The vector of Example 1 was linearized and electroporated into mouse embryonic stem cells. These cells are cultured and screened for the correct targeting event. The cells containing the correct target (replacing the ROSA26 locus with the new DNA allowing for conditional expression of the chimeric protein) are injected into blastocysts resulting in chimeric mice, which are also screened and the appropriate offspring are selected. Mice containing the imaging reporting transgene are then analyzed and used in conjunction with existing mouse cancer models such as those for alveolar rhabdomyosarcoma and medulloblastoma. A variety of cleavable hinges can also be used, as well as other binding proteins in addition to maltose binding proteins such as those mentioned above, targeting in different loci such as the Rpo2 locus, and using stronger promoters to obtain higher receptor density.

3. Example 3

Xenograft Tumor Mouse Model

Detection of Tumor Growth and Metastasis

Human tumor cells in culture are transfected via electroporation, lipofection, or tat-protein carrier with a plasmid, virus or retrovirus that expressed the chimeric receptor from a constitutive, non-variable transcriptional promoter. A recycle-promoting cleavable hinge is not added to the chimeric receptor. The cells are injected into the subcutaneous flank tissue of a immunocompromised (e.g., nude) mouse. As the tumor cells proliferate, the proportion of chimeric receptors on the surface of the tumor cells increases exponentially in proportion to the number of tumor cells present. The growth the resultant tumor at its original implantation location can be quantitated by many modalities including PET, CT, ultrasound, or MRI, and the metastases can be detected at high sensitivity with an accurate distribution profile of the target organs of metastasis. The response of the tumor and its metastases can be monitored following administration of a test drug(s), such as a DNA-damaging chemotherapeutic agent, e.g. Cyclophosphamide, or a biological modifier, e.g. as retinoic acid.

4. Example 4

Xenograft Tumor Mouse Model

Detection of Tumor Sensitivity to a Drug

Human tumor cells in culture are transfected by electroporation, lipofection, or tat-protein carrier with a plasmid, virus or retrovirus that expressed the chimeric receptor from a non-constitutive promoter that is only active when a certain cell-signaling pathway is active, e.g. the epidermal growth factor signaling pathway. A recycle-promoting cleavable hinge is added to the chimeric receptor to limit the survival of the receptor to minutes, thereby making signal of the receptor directly reflect the minute-to-minute activity of the promoter driving its expression. The cells are then injected into the subcutaneous flank tissue of a immunocompromised (e.g., nude) mouse. As the tumor cells proliferate, the proportion of chimeric receptors on the surface of the tumor cells increases exponentially in proportion to both the number of tumor cells present and the relative activity of the cell signaling pathway of interest. The efficacy of a treatment designed to specifically inhibit the cell signaling pathway of interest can be monitored by continuous, real-time monitoring of the chimeric receptor. The rapid "molecular response" of the tumor and its metastases to the treatment serves as a surrogate to tumor or metastasis regression. Therefore, screening of biological modifiers is more rapid and more specific.

5. Example 5

Non-Xenograft, Conditional Mouse Tumor Model

A mouse line expressing the chimeric receptor as a "activatable reporter" is bred to another mouse line with an activatable transforming mutation (e.g., a Trp53 mutation) and a third mouse line with a tissue-specific and/or temporally inducible "trigger", e.g. Cre expression, which activates the loxP-mediated activatable reporter and the loxP-mediated transforming mutation. Tumors arise in a more "authentic" fashion than for the xenograft models, e.g. breast cancer from a breast, brain tumors from the brain, muscle cancers from a muscle, with all the normal architecture experienced by the corresponding human tumor (vessels, lymphatics, immune surveillance). Treatments can be given to this conditional mouse model, and the response of the tumor can be monitored by chimeric receptor detection with one or more instrument/scanner.

6. Example 6

Human Cancer Patient Pre-Therapeutic Drug Screening

A human with a spontaneous tumor requiring treatment, e.g. a brain tumor, undergoes catheter-mediated transfection of a core region of the tumor with a plasmid, virus or retrovirus that expressed the chimeric receptor from a non-constitutive promoter that is only active when a certain cell-signaling pathway is active, e.g. the epidermal growth factor signaling pathway. A recycle-promoting cleavable hinge can be added to the chimeric receptor to limit the survival of the receptor to minutes, thereby making signal of the receptor directly reflect the minute-to-minute activity of the promoter driving its expression. The efficacy of serial test doses of different drugs designed to specifically inhibit the cell signaling pathway of interest can be monitored by continuous, real-time monitoring of the chimeric receptor. The rapid "molecular response" of the tumor and its metastases to these subtherapeutic, non-toxic "test doses" serves as a surrogate to tumor regression. Therefore, in a period of 1-4 days the most appropriate treatments with the best chance of response can be pre-selected for the patient.

7. Example 7

Monitoring Human Transplanted Stem Cells In Situ

Stem cells in culture are transfected by electroporation, lipofection, or tat-protein carrier with a plasmid, virus or retrovirus that expressed the chimeric receptor from a constitutive, non-variable transcriptional promoter. As an alternative to random integration into the genome, the chimeric reporter and its promoter can be targeting to a "safe" location in the genome such as the human Rosa26 locus by gene targeting. A recycle-promoting cleavable hinge is not added to the chimeric receptor. The cells are surgically implanted into the human recipient (e.g., a Parkinson's patient). As the stem cells proliferate, the proportion of chimeric receptors on the surface of the stem cells increases exponentially in proportion to the number of stem cells and stem cell derivatives present. The expansion of stem cells from the implantation location can be quantitated by many modalities (e.g., PET, CT, ultrasound, MRI, etc).

8. Example 8

Monitoring the Function of Human Transplanted Stem Cells In Situ

Stem cells in culture are transfected by electroporation, lipofection, or tat-protein carrier with a plasmid, virus or retrovirus that expressed the chimeric receptor from a non-constitutive promoter that is only active when a certain cell-signaling pathway is active, e.g. dopamine synthesis. A recycle-promoting cleavable hinge can be added to the chimeric receptor to limit the survival of the receptor to minutes, thereby making signal of the receptor directly reflect the minute-to-minute activity of the promoter driving its expression. The cells can be surgically implanted into the human recipient such as a Parkinson's patient, for example. As the stem cells differentiate, the proportion of chimeric receptors on the surface of the stem cell derivatives increases in proportion to the number of stem cell derivatives functioning properly by activating the signaling pathway of interest. The activity of the signaling pathway of interest, and its ability to be modulated by systemically administered drug treatments can be monitored in real time by means of the chimeric receptor (e.g., PET, CT, ultrasound, MRI, etc).

9. Example 9

The MultiPlat System

Figure 6:
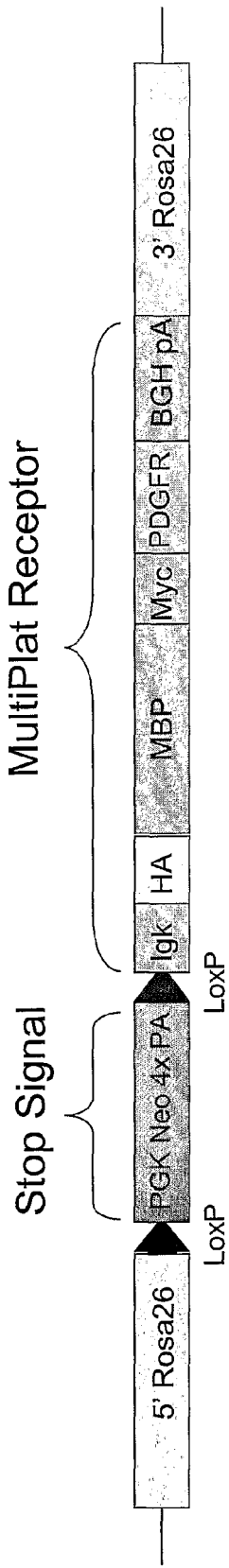
FIG. 6 shows the MultiPlat receptor is composed of a binding region (MBP) and a transmembrane domain (PDGFR). There are two tags (HA, Myc) to aid in future detection and characterization of the receptor and an lgk leader sequence which directs the MBP region to be expressed on the extracellular side of the cell membrane. The receptor is expressed from the Rosa26 locus and is preceded by a strong stop signal and selection (PGK Neo 4xPA) flanked by LoxP sequences which allow for conditional expression via the expression of Cre.

The pDisplay MBP construct was successfully cloned. The final vector (FIG. 6) shows genetic targeting of the Rosa26 locus which allows for ubiquitous expression of the chimeric receptor (also known as the Multi-Platform or MultiPlat receptor). LoxP sites flank a strong stop sequence directly following the Rosa26 promoter. This allows for suppression of expression of the MultiPlat receptor from the Rosa26 locus until the presence of Cre removes the stop sequence, activating expression of the MultiPlat receptor. This allows for tissue/cell specific activation of the MultiPlat receptor mediated by the location of Cre expression. Sequencing was performed to verify that all key components were intact and without error. The final vector was linearized and electroporated into mouse embryonic stem cells. 144 clones were selected and screen via southern blot analysis for correctly targeted clones. It was found that 26 of the 144 clones (18%) were correctly targeted. One of these clones was injected into mouse blastocysts to generate chimeric mice containing the targeted insert. Several high percentage chimeric mice were generated and further mated to obtain germline mice.

Figure 7A:
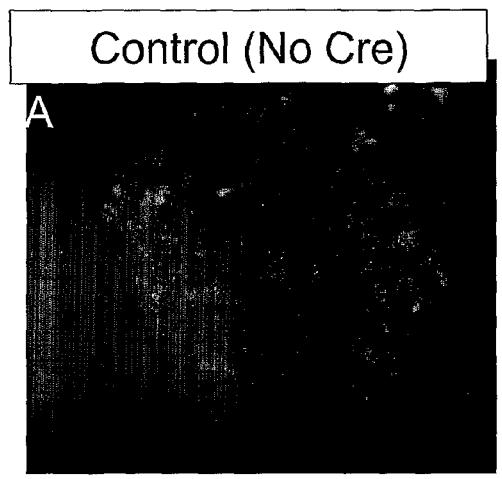
FIG. 7 shows immunohistochemical analysis of embryonic stem (ES) cells in culture which harbor maltose binding protein (MBP) receptor. Shown above is a epifluorescence photomicrograph of clones which contain DNA encoding the chimeric maltose binding receptor. The cells were labeled with DAPI to show cell nuclei and anti-MBP FITC to show chimeric receptor expression. The cells on the left (A) were not treated with cre and served as a control whereas the cells on the right (B) were treated with Cre protein to convert individual clones from a non-expressing state to an MBP expressing state. The clone on the right (B) is a mosaic clone of ES cells that were partially converted to the MBP expressing state (expressing cells), and the cells that do not express the surface MBP serve as an internal control.
Figure 7B:
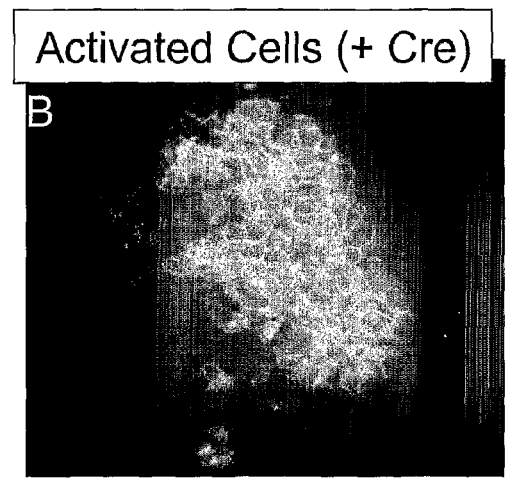

Correctly targeted embryonic stem cells possessing the ability to express the chimeric receptor were grown. Cre protein containing an HIV-Tat motif (to allow the Cre protein to cross into the cell nucleus) was applied to these cells on days two and three of their cell culture (it was necessary to allow the embryonic stem cells time to adhere to the feeder layer in order for them to grow). These cells were cultured for a period of five days on glass coverslips after which time immunohistochemistry was performed in order to determine if the MultiPlat receptor was expressed. The primary antibody was a mouse monoclonal antibody against maltose binding protein and the secondary antibody was a FITC labeled goat anti-mouse secondary antibody. It was found that the MultiPlat receptor was indeed expressed and these results are shown in FIG. 7.

A PCR strategy was created in order to determine the genotypes of the germline mice containing the genetic alteration allowing them the ability to express the MultiPlat receptor. Through using this PCR strategy it was found that the genetic alteration was in the mouse germline. Southern blot analysis can be used to confirm the presence of the genetic alteration in these mice.

Figure 8:
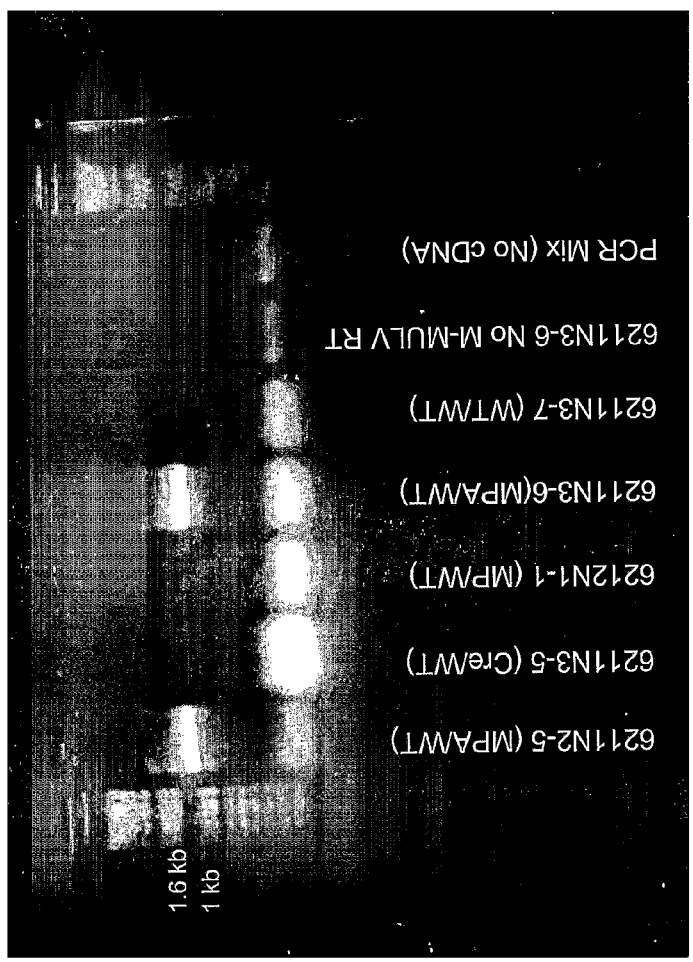
FIG. 8 shows RT-PCR of RNA extracted from mouse embryonic fibroblasts cultured to confluency. As expected, it can be seen that the cells positive for the MultiPlat receptor (genotype MPA/WT) are the only cells positive for the MultiPlat RNA. A control sample was run to with a MultiPlat expressing cell sample without reverse transcriptase (lane 6) to verify there was no DNA present. The band positive band was also the expected size (1232 bp).

A mouse containing the ability to express the MultiPlat receptor (genotype MP/WT) was mated to an HPRT Cre mouse (mouse with ubiquitous Cre expression). Mouse embryonic fibroblasts (MEFs) were created from the mouse embryos from this mating. The resulting genotypes of these fibroblast lines were as follows HPRT-Cre (Cre/WT), Unactivated MultiPlat (MP/WT), Wildtype (WT/WT) and Activated MultiPlat (MPA/WT). It was expected that only the activated MultiPlat (MPA/WT) mouse fibroblasts would express the MultiPlat receptor. The above mentioned cell lines were cultured in 100 mm cell culture dishes until reaching confluency. RNA was then extracted from these cells. RT-PCR was performed on the extracted RNA in order to create cDNA. This cDNA was then used in a PCR reaction to determine proper expression of RNA from the MEFs. It was found that only the activated MultiPlat MEFs expressed the MultiPlat mRNA and that the RNA fragment was the proper size (FIG. 8).

Figure 9:
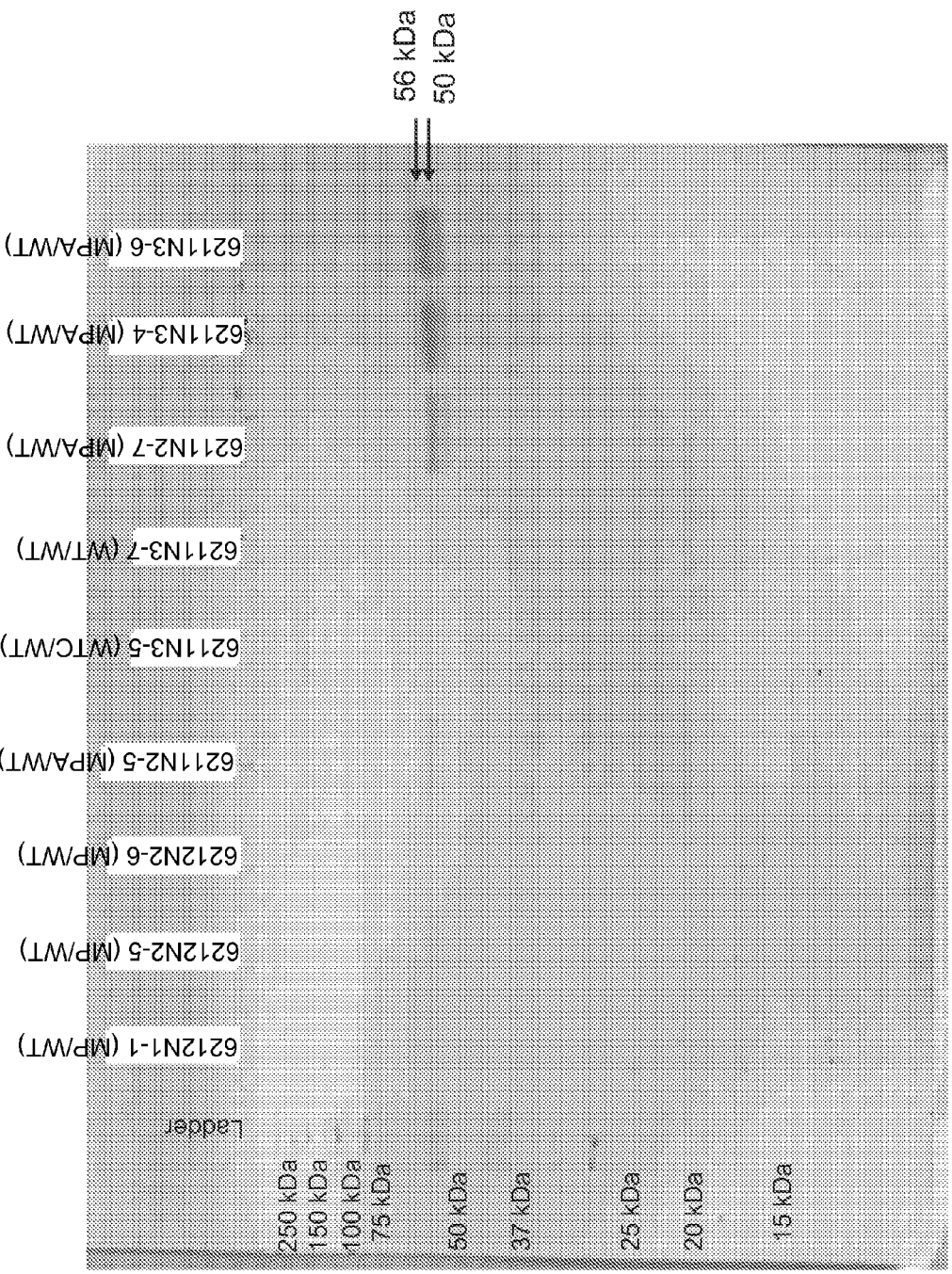
FIG. 9 shows western blot of protein extracts from mouse embryonic fibroblasts. The Cre-Activated cells are shown to express the Multi-Plat receptor (predicted to be approximately 56 kDa). 50 micrograms of total protein extract was loaded into all lanes with the exception of 6211N2-5 which contained 25 micrograms of total protein. Controls consisted of Non-activated cells (MP/WT), wild-type cells (WT/WT and Cre expressing wild type cells (WTC/WT).

The MEFs of genotypes listed above were cultured in 100 mm cell culture plates to confluency after which total protein was extracted from these cells. Western blot analysis was performed on these total protein extracts to determine if the MultiPlat receptor was expressed and if it was the appropriate predicted size (56 kDa). The same primary antibody was used as in the immunohistochemistry experiment listed above and an alkaline phosphatase conjugated goat anti-mouse secondary antibody was used in this experiment. It was found that only the activated MultiPlat cells expressed the MultiPlat protein and that this protein was indeed the predicted size (FIG. 9).

Two optical contrast agents, a FITC labeled and a Cy5.5 labeled maltose, have been derived. The limit of detection for these agents has been determined, and they are useful in both cell culture-based studies and in vivo mouse studies. It has been successfully shown that both maltose-cy5.5 and maltose-fitc were detectable to 10 nM in solution, without any attenuation of the fluorescence of either probe.

MEFs expressing the MultiPlat receptor along with non-expressing cells can be used as a control. Fluorescently labeled maltose (optical contrast agents mentioned above) are applied to a confluent plate of non-expressing and expressing cells and allowed time to bind. These cells are then be rinsed and subsequently imaged to determine if the MultiPlat receptor specifically binds the optical contrast agents.

A pharmacokinetic study of the optical contrast agents in mice can be undertaken. These agents are injected into the venous system of the mouse via the tail vein at varying concentrations. The distribution and signal from these agents are determined using an optical imaging machine over time. During this time a mouse expressing the MultiPlat receptor in a tissue/cell specific manner is generated. The appropriate dose (of the optical contrast agent is injected into the MultiPlat expressing mouse after which time the mouse is imaged over time to determine if tissue/cell specific imaging is possible.

F. References

Airenne, K. J., P. Sarkkinen, et al. (1994). "Production of recombinant avidin in *Escherichia coli*." Gene 144(1): 75-80.

Bajorath, J., Greenfield, B. et al. (1998). "Identification of cd44 residues important for hyaluronan binding and delineation of the binding site." J Biol Chem 273(1): 338-343.

Bayer, E. A. and M. Wilchek (1977). "The biotin transport system." Methods Enzymol 46: 613-7.

Blomback G: The N terminal disulfide knot of human fibrinogen. Br J Haematol 17:145, 1969

Chen, Y., C. Wiesmann, et al. (1999). "Selection and analysis of an optimized anti-VEGF antibody: crystal structure of an affinity-matured Fab in complex with antigen." J Mol Biol 293(4): 865-81.

D, Davie E W: Characterization of a cDNA coding for human protein C. Proc Natl Acad Sci USA 81:4766, 1984

Doring, K., T. Surrey, et al. (1999). "Effects of ligand binding on the internal dynamics of maltose-binding protein." Eur J Biochem 266(2): 477-483.

Doubrovin M., Ponomarev V., Serganova I., Soghomonian S., Myagawa T., Beresten T., Ageyeva L., Sadelain M., Koutcher J., Blasberg R. G., Tjuvajev J. G. *Development of a new reporter gene system—dsRed/xanthene phosphoribosyltransferase-xanthine for molecular imaging of processes behind the intact blood-brain barrier*. Mol. Imaging. 2003 April; 2(2):93-112.

Downing M R, Butkowski R J, Clark M M, Mann K G: Human prothrombin activation. J Biol Chem 250:8897, 1975

Eaton D, Rodriguez H, Vehar G A: Proteolytic processing of human Factor VIII. Biochemistry 25:505, 1986

Elion J, Butkowski R J, Downing M R, Mann K G: Primary structure of human fragment 2. Circulation 54:118, 1976

Engel A, Alexander B: Activation of chymotrypsinogen A by thrombin preparations. Biochemistry 3:3590, 1966

Finke, C., Reinauer, H. (1977). "Utilization of maltose and oligosaccharides after intravenous infusion in man." Nutr Metab 21(Suppl. 1): 115-117.

Graf L, Barat E, Borvendeg J et al: Action of thrombin on ovine, bovine and human pituitary growth hormones. Eur J Biochem 64:333, 1976

Hagen F S, Gray C L, O'Hara P et al: Characterization of a cDNA coding for human Factor VII. Proc Natl Acad Sci USA 83:2412, 1986

Heldebrant C M, Noyes C, Kingdon H S, Mann K G: The activation of prothrombin III. Biochem Biophys Res Comm 54:155, 1973

Horlacher, R., K. B. Xavier, et al. (1998). "Archaeal binding protein-dependent ABC transporter: molecular and biochemical analysis of the trehalose/maltose transport system of the hyperthermophilic archaeon *Thermococcus litoralis*." J Bacteriol 180(3): 680-9.

Hulsmann, A., R. Lurz, et al. (2000). "Maltose and maltodextrin transport in the thermoacidophilic gram-positive bacterium Alicyclobacillus acidocaldalius is mediated by a high-affinity transport system that includes a maltose binding protein tolerant to low pH." J Bacteriol 182(22): 6292-301.

Iwanaga S, Wallen P, Grandahl N Y et al: On the primary structure of human fibrinogen, isolation and characterization of N terminal fragments from plasmic digests. Eur J Biochem 8:189, 1964

Kam et al., "Human Complement Proteins D, C2, and B," J. Biol. Chem. 262(8):3444-3451 (1987)

Leavis P C, Rosenfeld S, Lu R C: Cleavage of a specific bond in troponin C by thrombin. Biochim Biophys Acta 535:281, 1978

Long GL, Belagaje RM, MacGillivray RTA: Cloning and sequencing of liver cDNA coding for bovine protein C. Proc Natl Acad Sci USA, Vol. 81, pp. 5653-5656, 1984;

Louie A. Y., Huber M. M., Ahrens E. T., Rothbacher U., Moats R., Jacobs R. E., Fraser S. E., Meade T. J. *In vivo visualization of gene expression using magnetic resonance imaging*. Nat Biotechnol. 2000 March; 18(3): 321-5.

Luncblad R I, Kingdon H S, Mann K G: Thrombin. Methods Enzymol 45:156, 1976

Magnusson S, Petersen T E, Sottrup-Jensen L, Claeys H: Complete primary structure of prothrombin. In Reich, Rifkin, Shaw (eds): Proteases and Biological Control. Cold Spring Harbor, N.Y., Cold Spring Harbor Laboratory, 1975

Mann K G, Jenny R J, Krishnaswamy S: Cofactor proteins in the assembly and expression of blood clotting enzyme complexes. Ann Rev Biochem 57:915, 1988

Martineau, P., W. Saurin, et al. (1990). "Progress in the identification of interaction sites on the periplasmic maltose binding protein from *E coli*." Biochimie 72(6-7): 397-402.

Medintz et al. *Self assembled nanoscale biosensors based on quantum dot FRET donors*. Nat Mat. 2003 September; 630-638.

Miller, D. M., 3rd, J. S. Olson, et al. (1983). "Rates of ligand binding to periplasmic proteins involved in bacterial transport and chemotaxis." J Biol Chem 258(22): 13665-72.

Moore A, Medarova Z, Potthast A, Dai G. *In vivo targeting of underglycosylated MUC-1 tumor antigen using a multimodal imaging probe*. Can Res. 2004 Mar. 1; 64(5):1821-7.

Morgan R J, Birken S, Canfield R E: The amino acid sequence of human chorionic gonadotropin, J Biol Chem 250:5247, 1975

Mutt V, Jorpes J E: Structure of procine cholecystorinin pancreozymin. Eur J Biochem 6:156, 1968

Mutt V, Magnusson S, Jorpes J E, Dahi E: Structure of procine secretin. Biochemistry 4:2358, 1965

Muzbek L, Gladner J A, Laki K: The fragmentation of actin by thrombin. Arch Biochem Biophys 167:99, 1975

Nakajima, K., Y. Oda, et al. (2002). "Time-resolved fluorometric analysis of carbohydrates labeled with amino-aromatic compounds by reductive amination." Analyst 127(7): 972-6.

Pugliese, L., M. Malcovati, et al. (1994). "Crystal structure of apo-avidin from hen egg-white." J Mol Biol 235(1): 42-6.

Quiocho, F. A., J. C. Spurlino, et al. (1997). "Extensive features of tight oligosaccharide binding revealed in high-resolution structures of the maltodextrin transport/chemosensory receptor." Structure 5(8): 997-1015.

Radcliffe R, Nemersen Y: Bovine Factor VII. Methods Enzymol 45:49, 1976

Ray P. De A., Min J-J, Tsien R. Y., Gambhir S. S. *Imaging tri-fusion multimodality reporter gene expression in living subjects*. Can Res. 2004 February; 64:1323-30.

Reimer P., Bader A., Weissleder R. *Application of a stable cell culture assay for the functional assessment of novel MR contrast agents*. Eur Radiol. 1997; 7(4):527-31.

Reimer P., Weissleder R., Wittenberg J., Brady T. J. *Receptor-directed contrast agents for MR imaging: preclinical evaluation with affinity assays*. Radiology. 1992 February; 182(2):565-9.

Sano, T. and C. R. Cantor (1990). "Expression of a cloned streptavidin gene in *Escherichia coli*." Proc Natl Acad Sci USA 87(1): 142-6.

Schier, R., J. Bye, et al. (1996). "Isolation of high-affinity monomeric human anti-c-erbB-2 single chain Fv using affinity-driven selection." J Mol Biol 255(1): 28-43.

Sharff, A. J., L. E. Rodseth, et al. (1993). "Refined 1.8-A structure reveals the mode of binding of beta-cyclodextrin to the maltodextrin binding protein." Biochemistry 32(40): 10553-9.

Shilton, B. H. and S. L. Mowbray (1995). "Simple models for the analysis of binding protein-dependent transport systems." Protein Sci 4(7): 1346-55.

Sparrow J T, Pownall H J, Hsu F et al: Lipid binding by fragment of apolipoprotein C-III-1 obtained by thrombin cleavage. Biochemistry 16:5427, 1977

Sprandel, U., Heuckenkamp, P.-U., et al. (1975). "Utilization of intravenous maltose." Nutr Metabol 19: 96-102.

Spurlino, J. C., G. Y. Lu, et al. (1991). "The 2.3-A resolution structure of the maltose- or maltodextrin-binding protein, a primary receptor of bacterial active transport and chemotaxis." J Biol Chem 266(8): 5202-19.

Srinivas S., Watanabe T., Lin C-S, Williams C. M., Tanabe Y., Jessell T. M., Costantini F. *Cre reporter strains produced by targeted insertion of EYFP and ECFP into the ROSA26 locus.* BMC Developmental Biology (2001) 1:4.

Sundaresan, G., Yazaki, P. J., et al. (2003). "1241-Labeled engineered anti-cea minibodies and diabodies allow high-contrast, antigen-specific small-animal pet imating of xenografts in athymic mice." J Nuc Med 44(12): 1962-1969.

Takagi T, Doolittle R F: Amino acid sequence studies on Factor XIII and the peptide released during its activation by thrombin. Biochemistry 13:750, 1974

Telmer, P. G. and B. H. Shilton (2003). "Insights into the conformational equilibria of maltose-binding protein by analysis of high affinity mutants." J Biol Chem 278(36): 34555-67.

Vera D. R., Buonocore M. H., Wisner E. R., Katzberg R. W., Standalnik R. C. *A molecular receptor-binding contrast agent for magnetic resonance imaging of the liver.* Acad Radiol. 1995 June; 2(6):497-506.

Vestweber, D. and J. E. Blanks (1999). "Mechanisms that regulate the function of the selectins and their ligands." Physiol Rev 79(1): 181-213.

Vu T K H, Hung D T, Wheaton V I, Coughlin S R: Molecular cloning of a functional thrombin receptor reveals a novel proteolytic mechanism of receptor activation. Cell 64:1057, 1991

Walz D A, Hewett-Emmett D, Seegers W H: Amino acid sequence of human prothrombin fragment 1 and 2. Proc Natl Acad Sci USA 74:1963, 1977

Weiner, H. L. (1994). "Oral tolerance." Proc Natl Acad Sci USA 91(23): 10762-5.

Wilchek, M. and E. A. Bayer (1990). "Introduction to avidin-biotin technology." Methods Enzymol 184: 5-13.

Yang, W. P., K. Green, et al. (1995). "CDR walking mutagenesis for the affinity maturation of a potent human anti-HIV-1 antibody into the picomolar range." J Mol Biol 254(3): 392-403.

Yao, X. Y., G. S. Hageman, et al. (1990). "Retinal adhesiveness is weakened by enzymatic modification of the interphotoreceptor matrix in vivo." Invest Opthalmol V is Sci 31(10): 2051-8.

Young, E. A. and E. Weser (1974). "The metabolism of maltose after intravenous injection in normal and diabetic subjects." J Clin Endocrinol Metab 38(2): 181-8.

SEQUENCE LISTING (95 sequences)

SEQ ID NO: 1 - protein, 392 aa, Artificial Sequence
  Description of Artificial Sequence; note = synthetic construct
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQT

SEQ ID NO: 2 - protein, 51 aa, Artificial Sequence
  Description of Artificial Sequence; note = synthetic construct
LNAVGQDTQEVIVVPHSLPFKVVVISAILALVVLTIISLIILIMLWQKKPR

SEQ ID NO: 3 - protein, 183 aa, Artificial Sequence
  Description of Artificial Sequence; note = synthetic construct
MQDSILTTVVKDIDGEVTTLEKFAGNVLLIVNVASKCGLTPQYEQLENIQKAWVDRGFMVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGKVIQRFSPDMTPEDPIVMESIKLALAK

SEQ ID NO: 4 - DNA, 10558 bp, Artificial Sequence
  Description of Artificial Sequence; note = synthetic construct
gcaacttgttgtcttctcaacaaattactgcttgctctggtcagccataatattgataataagaatcattgttatatcaattattattaatttttatgcgttatacggatagcagaaaactcacgcctgaaacggatgccaatcacaagaccgcttccccgcagcctattcggcgaatttccagccagacactgttaggtccggatggcaaactgattatcgatcatgacgggcaagaatatctgctccgtaaaactcaggctggcaagctgctgttgaccaagtagcctttaactcgagcagctgacttccagccgtttaccccagtcaggtggacgactgacatagtcatcatctctgtcgctgaaaggatttcgcaacgcctcatgcaggcggtgcaattccgtcatatcacccttttctgccgcttcaatcgcccgttgcgccaaccagttgcgcaataccagagcggggttaacgctttgcatcagttgctgacgctcactatcgctaacctcgtcttgttgcaaacgcccccgataacgggcaaaccagtcatcaaatgccgcacgatcaataaactcatcacgtagcggtgacgccgcgctgtgctgctcggtcagactcagcatgcggaatgtgcgggtataatcgctgcgctctcgcgccatcagactgaataattcattcagtagcgcgttatcctctttttgctccgtcatgaagcccagtttctgccgcatccgttctccataatgcgtcaacaaaacctgctgatagctgtccagggcctcattcagggcatctacggcaacaaatggcgacaatgtctgcgccagacgctgtaaattccacaacgcgacggcaggttgattatcaaagctgtaacgcccttgatgatccgagtgattacaaataaaaccgggttcgtaatcatcaagaaaaccaaacggcccgtaatcaagcgtcagccccagcagcgacatgttgtcggtattcatcaccccatgagcaaagccgaccgtctgccattgggcaattaacgacgcggtacgtgcgacaacatcgctaaaccagagacggtatttgtcctcatcatctgcaagatgtgaccagtaatgacgaatagcaaagtcagctaactgacgaaccttttccgactcgcggcggtagtaaaaatgttcgaaatgaccaaagcgcagatgacttggtgccacacgcatcagcatcgcgcctggctccgccgtttcccgatacactggcgaatcgctggtgacgatacttaacgcgcgggtcgtcggaatgcccagataatgcatcgcctcactggcgagactttctcgtatcgtcgaacgtaaaaccgcccgtccatcacccattcgcgaataaggcgtcaggccagcacctttcagatgccagtccattgtagtgccatcagcaagcagttgttcgccgagtaaaatgccgcgcccatcacccagttggcccgcccagacgccgaactgatgaccactgtaaacctgcgccagtggtgacataccaggcagtagggcttcgccgccccagacacctgcgccatttttaaacagcgacgatggaatactcagcgtgttagccagttcggtattatgccaaatcagccgggcattatttaaaggcgtaggggaaagtgctgtataggtttctggcaattcatcgcgccagcgggtaacaaaagacagggtcatagatcctcctgtttgatagtgtagacggttactctcgtcttaaacaccagcaaacagaagggttatcgctgaaccaacgtcgttatctgatttatgggaacggcaggccacaggcatccctggagagcatggaaatcgaagggggtaatctgtgccaatatttctgccgtatcaatgcctcccgcaatgatgcaattgcaacaaggggaaatttgcgcctggatcgcacgaataaacggttcgaaggagcggtgcgtgatttgttgctgaataaaacttttatccagcatgacgcgggtgaaaagaccatcaaaaaccgctttcattgtgctattgcctgctcccaaattacctaacacaaggggatacacttgcgataaggataaaagaccgcgattatcttttccttcattgagatgcgggtaattctcattaatcaacagttcaataaacggatattttaatagttcgcctgcgtaattatccctctctaataataatgtagccacttgtggcgttaaattaagccaggcaaagagtttatgttgaataaaaaaatgttggcatgattttagtaattccaactgctctgaaaataattgccaatgttgctcctcggtaagttgcgctataacccgactcgtcgggatacgaaccgtaccatcttcactggagaaatgggtaattaactcaacgccgacaaggacttgctggttgtctcttatcggcaggaaatagcaatcagaatgataaagattctccaaaaaaatcttcatggtaaccgtccctctcgaaggatgtttttcagtatccggctaaaagggatgaggccataagacataacaattacagaaggagtaactttcatttgttccatgttaaccactttttcaggggtcctttttttagattatcctgattataaacgaataatccatttacggaatttttgtctgcaaaatactactgtattcaggagtaaatggacggcgatgtatcatcgccgtccatttttcgacatactagattcgtctcgcctgccagaaatttttctgccaatagacattatcaagtgaggaacgcatcactcccttgctggtagaggcgtggataaattggttgttggtatcgtaaatacctacatgcaaaccattttgtccggaccccgttttgaaaaagaccaggtcacctggcagcaactcgtctttatcaatttgcgtgccaatagaggcttgttgtttggtttcacggggcagctgcaaatcgaaacgatcgcgcatcgtcacaaccacaaatcccgaacagtccacaccgcgccgcgtcatgccaccataacgatacggcgtgccatgccagctttgtagctggtcgttcaaaccggcaataacggtaatcgaatcagaaagtctggcatttggcggcggtgctttatggtggctacacccggccagaagcagtgctgtgatcaaaataaggcagaaacgcattccgtacggttcctctgttttttattcttgcattaatttagcgtcgtaattacccgattttcaagatactaatgaaatcagatggtcgaaatcagcattctgtgaccttcgatatccagacggcgaaaattcatcccataggcctgcgccagatttggcggcgtgagcacctcttccctgcgtccactggccagcatttttccaccttttagcaaccacgcccgatgcgcatgacgcaatgtgtggttgagatcgtgactgctcatcacaatcgccagtccttgctgacacagcgcgctcagaattttgtctaacgcactttgttgcgcaacatcaagactgttcatcggctcatcaagaagcagcaattggcctgcgggattggcttgtggtgtgatttgcaacaccaccgcagcaagacgtacgcgttgccattcaccgccggaaagttgattggtgctacgtccgagtttgtcatcaagagccagcgcccctgcgacatcattcagtagttcggtacgcgttttatcgtgctgatgcagtgtcaggtagtgccagaccggcgttgcaaacggcggcgtctgctgttgtgaaagataggcgcgatgcagcgcgagttttgttgcggaccatgcttccagtggttgccccgcgaactgaatgcttcccttaccgctggtcattccggccattcgcgccagtaaggtactcttacccgcgccattcggccccaccaggtgcaggatctccccagcccgaacctcgccagaaagcggccccaggcgggtagattccgcaacatcttgtaactgcatcacaatagacattattttgccaacgccagtttaatgctttccatcacaatgggatcttccggcgtcatatccggggaaaaacgctggatgacttttccgtccctgccaaccaggaatttttcaaaattccataaaatatcatccgggtacagcggtgcacggcctttgctgaccatacgggcatagaatccgctctcttccggcgcgactgcggtcggcgctgcggcaatcaatttttgatacagcggatggcgtccttcgccattaacttcaatcttactgaacatcgggaacgtcaccccccatgtggtggtacagtaagttttaatctcttcatcgctgcccggttcttgttccagaaactggttgcacgggaatcccagcaccataaaacctcgatcgacccaggctttctgaatattctccaactgctcatattgcggcgttaagccacactttgaggcgacattgacaatcaacagcacattaccggcgaacttctccagcgtggtcacttcaccgtcgatatctttcactacggtcgtcagaatggaatcttgcatcgtttctcctgggtgtggtcagtaaaaatcttagcttttaatcatagaccgtctttttgcggctaacgtcctgcttttaacaataaccagataaacaccggcgcacctaacgttgcggtgaccacgccaataggcagctctgcggcagctaatgccaggcgcgctacaatatcggccagcagcaatgcgctcgcccctgccagcgcgcagccgggaagtaatacgcgatgatcggttaaaccacacaaccggagaatatgggggatcaccagaccaataaagccgatagcacccgccagcgccacactgacgccaaccatccagccggtcgctgccaccagcacattgcgccagaaccacaggggtaaacccagttgccgcgccgagatctcgccaagtgctaacatattcatcggcctggactgacaacagatccacaacaacacggggatcaatgccagcatcagccagctttgccgccagtctacgccgccaaaaccgcccatcatccagtacatcagctgacgcaaatcaactgaggtggaaaagtagatagcccacgtcattagtgcgctacagataatccctaatgcaacgccagccagcaataaccgactggtcgaaagatgacgacgggcgaaacgtaagagtattaaagtgatgataagcgcgccagcaatcgcacacagccctagcgcccagttggggagttgcccttgcccaagcaataccgcggcgataagccccacgcctgcgccgttagagacgccaagtagtccaggttctgccagaggattttcaaacaacgcctgcattacagcgccggatatagccagcgccgcaccaaccagcaatacagccagcgtacgtggcaggcgaatttgccagacgaacagttcgccacgaggagtaaaccagtcacctggcgagatccattgttcaccggcgcaaaggcttaagagaagcgccagcagcatcaaaactgacaggcataataaccagcgaatattttgtcgctgttgttggcgggcaagtgtcagcatggtatccgttctgctgaagtgtcatggcgttgattttacggtgactcttcgacagtgaaaagaaaaaaggccgcagagcggcctttttagttagatcagattactcgtctttgggcgaagcgttttcgacccggctttttaacttctgcccgggtctgaaggtcaccacgcgccgtgctgtaatgggaatatcctcgcccgttttcgggttacgtcccgggcgttgattcttatcacgcagatcgaagttaccaaaaccagagagtttcacctgttcgccgttttccagagcgcgacggatctcttcgaaaaacagttcaaccagttctttggcatcccgcttgctaagcccaagcttatcaaacagatattctgacatttcagcttttgtaagcgccataggttcaatccctcaatgatgcctggaatcgctcttttaatgcctctacacatttggcgacggtagcggcaatctcctcttcttcgagtgtacggctggtatcttgcaggatcaggcttatggcgaggctcttatacccctccgcaacacccttaccgcggtacacgtcaaataagtttacgccaactacctgatttacgccaactttcttacattcggataaaatatccgctgcgggaacgttttctgcgaccaccaccgcgatgtcacgacggttcgccgggaagcgagaaatctcgcgcgcctgaggcaccacgcggtctgcgagcttgttccactccagttcgaacaccagagtgcgaccgttaagatccagtttacgttccagttcaggatgaacaaccccaacaaaaccaatacgttcacctttcagataaatcgctgcggattgccccggatgcagtgccggattcgcttctgcacggaactcaacctcattcagtttaccggtcaggtcgagaacggattcaagatcgcctttcaaatcatagaaatcaacggtctcttttgccaggttccagtgctcttcgtaacggttaccgcaaatcacaccggctaacatcagatcctgacgaatgcccaacggtgcctgagtatctggtacgaaacgcagaccgctttcgaaaatgcgcacacggttctgctgacggttctggttgtacaccacggttgccagcaggccagtccacagagaaagacgcattgctgacatttcaacagagatcgggcttggcagcagtaaggcttcaacgcctggatggatcatctgctgcactttcggatcaacgaagctgtaggtgatcacttcctgatagcctttgtcgttgagcagcgttttcacgcgcttgagcgacaggtcagcttcacggtgagtacccataatcaggcttgcctgtaccggctcatccgggatgttgttgtagccgtaaacacgcgcgacttcttcaaccagatcttcttcaatctccatatcgaaacgccagctcggcgcaactgcctgccattcgtctttgccttcggtcacttcgcagccgagacgacgcagaatgtcagttacctgctcatccgcaatatgatggccgatcaggcgatccagtttgctacgacgtagagtgatggttgcacgcttcggcagcgttgcttcgttggtgatatcaattaccgggccagcctcaccaccgcagatgtcgatcagcagacgggtcgcacgttccatcgctttgtgctgcagtgccggatcaacgccacgctcataacggtgagacgcatcggtatgcaggccatgacgacgagcacgaccggtgatagacagcgggctaaagaacgcgcattccagcagcacgttttgtgtttcgtcattcacgccagagtgttcgccaccgaagatgccgcccatcgccagcgccttgttgtggtcggcgatgaccagagtgtcagcattcagcttcgcttcagtaccgtcgagcagcaccagcgtttcgccctctttcgccatccgcaccacaatgccgccttcaatgcgatctttatcgaaagcgtgcatcggctggcccagttcgagcagcacatagttggtgacgtcaacaactgcatcgatagaacggatcccgcaacgacgcagtttttctttcatccacagcggagttggcgctttaacgttaatgccttttaccacacggccaagataacgcgggcaggcttccggcgcttcgactgtaatcggcagcgtgtcgtcgatggtcgcaccaaccggaacgatttccggttgaaccagcggcagctggttcagcacggcaacgtcacgcgcaacaccaatgatgcctaagcagtcggcacggtttggcgtcacgctgatttcgatggtgttgtcatcaagtttcaggtattcacggatatcggtgccaatcggcgcatccgcaggcagttcgataatgccgctgtgatcgtcagaaatgcccagttcagagaaggagcacagcatcccttcagacggttcgccacgcagtttcgccgctttaattttgaaatcacccggcagaacagcaccaatggtcgctaccgctacacgcaggccctgacggcagtttggcgcaccgcagacgatgtccagcaggcgatcgccgccgacattcacttttgtcacacgcagtttgtcagcgttcggatgctgcgcacactcaaccacttcaccaacgaccacgccgtggaagctgccggcaaccggttctacaccgtcaacttccaggcccgccatagtgatttgatttgccagcgcatcgctatcaatcgccgggttcacccattcgcgtaaccacagttcactgaatttcataatctattcctgccttatttaaactgtttgaggaaacgcagatcgttttcgaagaatgaacgcaggtcggtgacgccgtaacgcaacatagtcagacgctccatccccatcccgaaggcgaaaccagagtaaacttccgggtcgatgccaacgttacgcaacacgttcggatgcaccatcccgcagcccagcacttccagccatttaccgtttttacccatgacgtccacttctgcagaaggttcggtaaacgggaagtaggaaggacggaagcgaatctgcaaatcttcctcaaagaagttacgcaggaagtcgtgcagcgtgcctttcaggttggtaaagctgatgttggtatcaacaatcagaccttccatctgatggaacatcggcgtgtgagtctggtcgtagtcgttacgataaacacggccaggcgcgatgatacgaatcggtggctgctgggctttcatggtgcggatctgtacgccagaggtctgggtacgcagcaggcgggtagtgtcaaaccagaaagtgtcgtggtcagcgcgcgccgggtggtgaccaggaatgttcagagcatcgaagttatgataatcgtcttcgatttccggcccggttgccacggtaaagccaagctcaccgaagaaactttcgatacggtcgatggtacgggtaaccggatgcagaccgccgttttcaatgcgacgacctggcagagagacatcaatcgtttccgccgccagacgcgcattcagtgcagcgctttccagttccgctttacgcgcattcagcgcctgctgaacctgctctttcgcttcgttgataaccgcaccagctgccggacgctcttctggcggcagctcacgcagggtcgtcatctgaagggttaagtgcccttttttacccaaatattcgacgcgcacattatctaacgcggcaacatctgacgcctggctaatggccgccttcgcactggcaaccagttctgcgagatgtgacatggttttcctcattgtgtcagtggtgacactggttcgttggacttagagcctatcccatcaggctattttacttgccattttggtcccgggctgtgctcgaaattctcacgtacttaaatacgctccggtttctccgcgctggccgtgtccagtctggctgcgacaattacacctgatgagacaggctttttatttttcaaaacgcgcatacaaaaaaagcctccactgggaggctttcaggcgctgttttccgtttctcttctcacgcgctagcctcctggattcaggtgctaaagtaaaaaaagaagcggaaaatagcagcattcattgcttgcgttaccttttggtactcttcaaaagacctttattgaaaaggctacggcgataaaagtcaatgttttgatggcgttgaaacgaaaagagggagactagctccctctttcaactggcttatgccagagctgctttcgctttttcaaccagagcggtgaacgctactttgtcgaatactgcgatatcagccaggatcttacggtcgatttcaacagaggcttttttcaggccattgatgaatttgctgtaagaaataccgttctgacgtgctgctgcgttgatacgcgcaatccacagttgacggaactgacgcttacgttgacgacggtcacggtaagcatactgaccagctttgataacagcctggaaggcaacgcggtatacgcgagaacgcgcaccgtagtagcctttagcttgtttcaaaattttcttgtgacgtgcacgtgcaataacaccacgttttacgcgagccatatgtgctctcctgtatctatattctaattaaaaagttaaaaacgttaacggcttatgcgtacggcaggcacgcgattaccaggcccagatcgcctttggaaaccatggctttcggacgcaggtgacgtttacgtttggtcgcttttttggtcagaatgtgacgcaggttagcgtgcttgtgcttaaaaccacctttaccggtttttttgaagcgcttagcagcaccgcgtacggtcttaatttttggcattttaataacttccacttcgcattgttaataaacgaaacaaaggcgaacaaagcctgtgaagcccgaaggctccaca

SEQ ID NO: 5 - protein, 535 aa, Artificial Sequence
  Description of Artificial Sequence; note = synthetic construct
MRISLKKSGMLKLGLSLVAMTVAASVQAKTLVYCSEGSPEGFNPQLFTSGTTYDASSVPLYNRLVEFKIGTTEVIPGLAEKWEVSEDGKTYTFHLRKGVKWHDNKEFKPTRELNADDVVFSFDRQKNAQNPYHKVSGGSYEYFEGMGLPELISEVKKVDDNTVQFVLTRPEAPFLADLAMDFASILSKEYADAMMKAGTPEKLDLNPIGTGPFQLQQYQKDSRIRYKAFDGYWGTKPQIDTLVFSITPDASVRYAKLQKNECQVMPYPNPADIARMKQDKSINLMEMPGLNVGYLSYNVQKKPLDDVKVRQALTYAVNKDAIIKAVYQGAGVSAKNLIPPTMWGYNDDVQDYTYDPEKAKALLKEAGLEKGFSIDLWAMPVQRPYNPNARRMAEMIQADWAKVGVQAKIVTYEWGEYLKRAKDGEHQTVMMGWTGDNGDPDNFFATLFSCAASEQGSNYSKWCYKPFEDLIQPARATDDHNKRVELYKQAQVVMHDQAPALIIAHSTVFEPVRKEVKGYVVDPLGKHHFENVSIE

SEQ ID NO: 6 - DNA, 11575 bp, Artificial Sequence
  Description of Artificial Sequence; note = synthetic construct
ttcgccggtttattgtttacggcgagacgggaatttgctcactttttgactttccgttacgcaacagaaaaagttaaaaacgaaaagactaaaatcacacgtcttgtgaccttctaaattgattcacatgctaaatctgataagttttaatttcaatggtaggtttatttcttagctttcgctagtaaactgataatcagacaaaatggtgacatgagggacattgtggaccctgtattctctatcggtatctcatcattatgggatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccggcgaaaatctttcaattagatgattctcaagggccggaaaaaataaaattattttcaatgctaaatcatgaaaaaggtctatactatttgacccgtgatttgcagtgttctattgatccccataattacctttttattcttgtttgcgcaaataacgcatggcaaaacattcctgccgagcggcttcgctcatggttggataaaatgaataaatggagcaggttaaaccattgttcgcttttggtaattaatcccggaaataataacgataaacaattttcattgttgcttgaggaataccgttcactttttggtcttgccagtttgcgttttcagggtgaccaacatttgctggatattgccttctggtgcaacgaaaaaggggtcagcgcccgtcagcagcttagcgttcagcaacaaaatggtatctggacattagttcaaagcgaagaggcggagatccaaccacgcagcgacgaaaaacgcattctgagtaatgttgctgtactggaaggtgcgccgccgctatcggaacactggcaactgttcaacaataacgaagtcctgttcaatgaagcccgtaccgctcaggcggcgacggtggtcttttctttacagcaaaatgcgcaaatcgagccactggcccgcagcattcataccctgcgtcgccagcgcggtagtgcgatgaaaatcctcgtgcgggaaaataccgctagcctgcgcgccaccgatgaacgtttgttattggcctgcggtgcaaatatggttattccgtggaatgcgccactctcccgttgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgaacaagccctgacgctgtgtcgccctaaccgtaccggcgatatcatgaccattggcggtaatcggctggtgctgtttctctcattctgtcggattaacgatctggataccgcgttgaatcatattttcccattgcctactggcgacattttctcaaaccgtatggtctggtttgaagatgatcaaatcagtgccgagctggtgcagatgcgcttgcttgccccagaacaatggggcatgccgctgcctttaacgcaaagttctaaaccggtcatcaatgccgagcacgatggtcgccactggcgacgaataccagaacccatgcgactgttagatgatgctgtggagcgctcatcatgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatgactcaatttacgcaaaataccgccatgccttcttccctctggcaatactggcgcggcctttccggctggaacttctattttctggttaagttcggcctgttgtgggcgggatatcttaacttccatccgctcctcaatttggtgtttgccgcgtttctgctgatgccccttccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgaccttgtcacacgctttattaactggcagatgattggggccatttttgttttattagtggcctggttattcctgtcacaatggattcgcattaccgtttttgtggttgccatactgctatggctgaacgtacttaccctggcgggaccaagtttctccttgtggccagccggacaaccgacgaccactgtaacaacgacgggtggtaacgcagcggcaaccgttgcggcgacgggtggcgcaccggtagtgggtgatatgcccgcacaaactgcaccgccaacaacggcgaaccttaacgcctggctgaataatttctataacgcggaggcgaaacgtaaatcgaccttcccgtcttcgctgcccgctgatgctcagccatttgaactactggtgattaacatctgttcgctttcctggtcggatatagaagccgccgggttgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctttcgaaactgggctttacccagcacctgatgatgggacataacggccagttcggcggttttttgaaagaagttcgcgaaaatggcggcatgcagagcgaattgatggatcaaacaaatctgccggttattttgctgggctttgatggttcgccggtttatgacgataccgctgtgcttaaccgctggctggacgttaccgaaaaagataaaaacagccgtagtgccacgttctacaacacgcttccactgcatgacggcaaccattatccgggggtcagcaaaacagcggattacaaagcgcgggcgcagaaattctttgatgaactggacgccttctttactgaacttgagaaatcgggtcgtaaagtgatggtggtcgtggtgccggaacacggcggcgcgctgaagggcgacagaatgcaggtatctggcctacgtgatatccctagcccgtctatcaccgacgtccccgttggggtgaaattcttcggcatgaaggcaccgcatcagggggcaccgattgtcatcgaacaaccgagcagcttcctggctatctccgatctggtggttcgcgttctcgatggcaagattttcaccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcagtaagaacgaaaaaggccgcagagtttcccccctgcggcctggtccgggcgcaaattgccattacggcagcctgacgcccgcatgacacgttacttccgcttgttcagccagttcacgatcatactggcaagaatgccagcaatgaccggagccgctaaatcatgccagaaggccatgcccagctctgcgaacgtcatatagccgcctgtgttgtaatgacaacgtttcgcggctattcttgagtggtctagagtcaagattagcccccgtggtgttgtcaggtgcatacctgcaacgtgcgggggttttctctctccagcaaccaatgccaccagggataaagcccccgcaacattgcgcctcaccggaacctttccggcttgccgctgattctacgattgctttttactgtcagcacccggcaatcttcctcattgcgcgatgccttccagcttaatttctttatttgcaatagttgcagttcatatccgggctgactccagactggtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactggtggcgattgcgtctggtggtgaacgattactgtttaagatttccgggccaatggtggtggtcaaagtagggattattgtcgtgttcggttttgcgatgatcccgcactggaatttcgccaatataaccgccttcccgcaagcctccgtctttttccgcgatgtcttgcttaccattccattttgcttcttttctgcagtatttattcaggtacttaacccaatgaatattgcctatcgtaaacgggaagcggataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcagcactggcgctggccgcgcaggtgatccctgggcatatcattcatatcacctctacggtgcttaatatctttgccgtactgaccgcattctttggcatttatctcggtttccacgaggccattaaaggcattattctcaatctgttaagccgaattattgataccaagaaaattaactcacgcgtgctgactctggcgatctgcgcttttatcgtcattacgttgacgatttgggtttcgtttcgtgtatcggtgctggtgttctttcagttgggaagcccgttatatggtattgtgtcgtgcctcattccgtttttcctgatctataaagtcgcacaactggaaaaacttcgcggatttaaagcctggctgattctgctgtacggcattttgctatgcttgtcgccactgttgaagctgattgagtaaaccggagcgcatggccccggttttgtgagttaacgctgcggattttcatcctgatcaacagcaaaacaagctaccagttgaccgccgtagtcttttagctgcggctgcaactgggtgcaggggccgaagcgccgacgacagcgggcgttgaaggcgcaacccggcggtggattcagtgggcttggtagttcaccgctgagcttgatgcgctcgcggcgatcgtccgggttcaggcgcggcgtcgcggaaagtagcgcctgagtgtacggatggcgcgggttattgaagatttggtctttcgttcccttctccacgcagcggcccaggtacatcaccatcacttcatcagcaatgtgctccaccaccgacaggtcgtgggagataaagacataagacagccccaactcctgctgcaaatccatcatcagattcagcacctgcgcgcgcactgaaacatccagcgcggaaaccggttcatcggcaatcaccacatccgggtcgagcatcagaccacgggcgatggcgatacgctgacgctgaccgccggagaacatatgcggatagcggtcatagtgctcggttttcaggccgactttcgccatcatcgacagggctttttcccgacgctgttctttgcttaagctggtgttgatcagcagcggctcttcaagaatttgcccgacttttttacgcggattcagcgaaccgtaagggttctggaagacgatctggattttctgccgacgcagcttctgcgcctgcggatcgtgcttaagcagatcctgcccctggtaatacagctcgccaccggtgggcatttcaatcatcgtcagcaaccgaccgagggtcgatttaccgcagccagattcgcccactactgccagcgttttgccacgttcaaggttaaacgaaacgccatccagcgctttaaccagacgttccggcgcgaacatgcctttcttcaccggataatgttttttcaggtcgatagcctgcaacagcggttgttgcagggtggcctcttgcgtactcatagtgtcggcctcccggcatcatcaagtgggtaatggcatttggactgacgcccgtcagcgagcatattcagcgccggttcttcagcgcgacatctgtcagtggcataggggcagcgcgggttaagcaggcagccgttcgggcggtcgtacttgccgggaacgacacctggcaacgacgccagacgttctttgtcctgagcaaattctggcagcgcacgcagcaatgcctgagtatacgggtgacgcggcgcatggaagatggcgtgcgcatcaccggtttccaccacctggcctgcatacatcacgatgattttatgtgccgcttccgccaccagcgccaggtcatgggtaattaacaccagcgccatgttctctttctgctgtagctccagcagtagttcgatgatttgcgcctgaatggtcacgtccagcgcggtggtcggttcatcggcaatcagcagttttggccgacaggcaatcgccatggcgatcatcacgcgctggctcatgccgccggaaagctgatgcgggtaaacatccagacgcgatgccggatcgggaataccgacctgattcagcaggtcaatcgctcgctgacggcgggtacttttgttgccgccctgatgcaccttaatcgcttccataatctggaaacccacggtgtagcacgggttaaggctggtcatcgggtcctggaagatcatcgccacttcggcacccaccaggttgcggcgctctttttctgagatacgctgcaaatcctggccgttaaactccagtttttctgccattacgcggcccggataatcaatcagccccataatcgccagtgaactgaccgacttaccggagccggactcacccacaatcccgaccacttcgccctgttttacgctgtagctgatgcggtctacggcgcggaacggcgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacgtcggagagcatggtgccccactcaggcgttggcggctgtgcccccatgccgaggaaaccaagagcagccatatcgagaatggcgttagagaaaccgagcgacgcctgaacaatcagcggcgcaaggcagttcgggaagatgttaataaacatctgacgcatcgccccggcacccgccacgcgagacgcggtgacgtaatcgcggttaacttccaccagcacggcggcgcgggttaagcgcacatagtgcggcaaggcaacgaaggtcagtgccagcgcggcgttaccaatcgacgggccgaaaattgccaccagcaccagcgccagcagcagacttggcagcgccagcatgatatcgaccacgcgcataatgatgttatcgaccaggccgccaaagtaaccggcgatcaggccgagaataacgcccataatcagcgataacacaactaccagacagccaaccagcagcgacaggcgcgcaccgtacatcaggcgcgacagcacatcacggcctacgtcatcggtgcccagcaagtgcgccatgctgccgccttcctgccaggctggcggggcgagcagtgcatcgcggaactgttccgccgggttatagggtgcaatccagttggcaaagatcgcgatgaacagcacgatgacgacgtaaaccagcccgacgaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaagttgacgaggataatcatcgtcgccaccagcaatacgccgccctgcactaccggatagtcgcggcgttgcagtgcgtcaatcaaccagcgtcccagaccgggccacgagaagatggtttcggtcagaatcgcccccgccagcaatgttcccacctgcaggccgataacggtcaccaccggcagcatcgcgttacgcagcgcatggacgataatcacccgcatgcgggttagccctttggcgcgcgcggtgcggatgtaatcctcgcccagcacttccagcatcgaggagcgtgtcatacgcacaatgaccgccagcggaatagtacccagcacaatggcaggcaagatcatatgggcgacggcatcgataaagttgccgtcttcaccccagatggcggtgtcgattagcataaaaccggttaacggattggagtcatcgaggaacaccatatcgctcacgcgaccggagacgggcgtcaggttccagtgcaccgaaaccagcatgatcagcatcatgccccaccagaagataggcattgaataacctgtcagcgccaggccaaccgctgtgtgatcgaaaatggaaccgcgtttaaccgcagccagcacgccgaccggaataccgactgccgtagcaaaaatcatcgcgcagacgccaagttccagcgtggcctggaagcgcggcacgaactcttcccaaaccgggatgcggcttttcattgaaatgcctagatcgccatgcataacgccccaaatgtaatggagatactgctgccacatcggtttatctaagccgagttcagccagcagctgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctatagtgacccgcagcctggaactgcgtgtctgtattgctcacaaatcaattcccgcccttatcggacagggaatgaagtattgctgccggatggcgctgcacgcagaggcacagcgccaccgggtatacagattgttgacaaagtgcgctttgtttatgccggatgcgcggttaacgccttatccggcctacaaaatcgtgcaaattcaatacattgcagaattttcgtaggcctgataagcggagcgcatcaggcatttttgcctttgccatcagtcttgtatggcttttaattattcgatagagacgttttcgaagtgatgtttgcctaatggatcaaccacatagcctttaacttctttacgtaccggttcaaacacggtggagtgagcgatgatcagtgccggagcctgatcgtgcatcaccacctgcgcttgtttgtacagttcaacgcgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctggtgctcgccatctttcgcacgcttgaggtactcaccccattcgtaggtgacaattttggcctgcacgccgactttcgcccagtctgcctgaatcatctccgccatgcggcgagcgttcgggttatacggacgttgtaccggcatcgcccacaggtcgatggagaaacctttttccagacccgcttctttcagcaaggctttcgctttttcaggatcgtaggtgtagtcctgaacgtcgtcgttatagccccacatggttggcgggatcaggtttttcgctgatacgcccgcgccctgataaaccgctttgatgatcgcgtctttgttcaccgcgtaggtcagagcctggcgaactttcacgtcatcgagtggttttttctgcacgttatacgagagataaccgacgttcagccccggcatttccatcagattgatggatttatcctgcttcatgcgagcgatatctgccgggttcgggtacggcatcacctggcattcattcttctgcaatttcgcgtaacgcacggaagcgtcaggggtaatagagaaaaccagcgtatcgatctgcggtttggtgccccagtagccatcaaacgctttgtagcggatacgggaatctttttgatactgctgtaactggaacggaccggttccgattgggttgaggtccagtttttccggtgtaccggctttcatcatcgcatcagcatattcttttgacagaatagaggcgaagtccattgccaggtcagcgaggaacggcgcttccgggcgagtcagcacaaactgaacggtgttgtcgtccacctttttcacttcactgatcagctctggcaagcccatgccttcgaagtattcgtagctgccgccagaaactttatggtacgggttttgcgcgtttttctgacgatcgaacgagaacaccacatcatcggcgttcagttcacgcgtcggtttgaattctttattgtcgtgccacttcacacctttacgcagatggaaggtataggttttaccgtcttcgctgacttcccacttttcagcgaggcccgggatcacttcggtggtgccgattttaaattcaaccagacggttataaagcgggacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgt

SEQ ID NO: 7 - protein, 302 aa, Artificial Sequence
  Description of Artificial Sequence; note = synthetic construct
MIMLAFIRFLFAGLLLVISHAFAATVQDEHGTFTLEKTPQRIVVLELSFADALAAVDVIPIGIADDNDAKRILPEVRAHLKPWQSVGTRAQPSLEAIAALKPDLIIADSSRHAGVYIALQQIAPVLLLKSRNETYAENLQSAAIIGEMVGKKREMQARLEQHKERMAQWASQLPKGTRVAFGTSREQQFNLHTQETWTGSVLASLGLNVPAAMAGASMPSIGLEQLLAVNPAWLLVAHYREESIVKRWQQDPLWQMLTAAQKQQVASVDSNTWARMRGIFAAERIAADTVKIFHHQPLTVVK

SEQ ID NO: 8 - DNA, 10244 bp, Artificial Sequence
  Description of Artificial Sequence; note = synthetic construct
aaaacatcccttaaaaccaatctaatctttttcttcctctgtgtatttgttccccatatggcgtcataatttacgctacgtaatacgggatagttacgatacgcagcgatagcgctaagttttagttaaaatcccccatcagcgggatatggggatctctgggaggttcaggttttagcatcgcgactttaatacgacagacgctggtgacgatgatgccaagtagtgactcttccgaataaggttcccactgaccaattggcgcgcgcttcgcaataaaatctcccttcgcccagtattgggaaaagtagatacattcaaactgtgtacgctgtttcgtctcacagttcacgacattgctggccgatgagctgaccattgggcctatccgggctgtcccgatggatattacgccgaagtatgtgggaattgccagcggattgatgaacgccggttccgctgtcgccgacattatttcacctatcgcctttggcattattatcgacaaaacaggcaactggagtttaccattctacggttccgtcgcattgcttgttattggtatattcctgacgttcttcatgcgtccagataagtcattgtaaaagtcgaatcagggctgaagtggcacactgaatttggccacctgaacagaggtgatatgctcacctcagaacaacacaggtgctccaatgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacggattgaaatggagaatgaaatattaaaaaggctactgtagattcaatctgtcaatgcaacacccctttcaattatctctttcggtgttttgaacttcagtgtctttctcggtctgttgtttagctgagcagcaaccagatctagttcatgttgagtatattgggcaagacatgtctttttaggaaagtactgccgaattagcccatttgtgttctcatttgttccccgctgccaaggactctgaggatcgcagaagtaaactttaacgccggtgctgacagtaaattctagatgtctggccagttccattcctctgtcccatgtcagtgattttctgagttctgacggtaaactcaggaatttgtcggtaagagcctgatttactgagacagaatctttgcccctgagtctaaggatgatcgtataacgtgattttcggtctacaagtgtggctatatgagagttttttgtacctgagactaaatcgccctcccaatgccctagagagcgtctgttatcgatatttcgggaacgttcgtgaattggtgttccgttcactatgttaatcgtacctctttcgcctttgcgggtatgacgcctgccatggcgaaggctatgcgaccgtcgcagatgctgtatattcaggtggtgtagcgcttcacggctacgaaagtacagcgttttataaattgtctcaggtgatattcgcagcgttttttgacgtggttttgttcgccttaaccatcctgatatttgctctggagaccatttcatctccagcttttccagaacaagctttcgcaatggtaaattttgatccagtaagcacggttttggccttttcgccattctgttggctcggttattagcatcaacagctttgtaatagcgtctgccccgattacgctgaacttcacgtgagatcgtcgaaggactgcgattcagcgcagtagctatcgcacgaatgctcattttggctgacaaaccagctcgtatctcctcgcgctcagacagtgtcaggtgagctacagcccgcttacgctcatggggttttatgccgccagtatcccttaacatagtgaagatcgttccgggttttgaacccaggatattcgctatttcactgaagcctgttccgttcttccatagttcaaaaacagaggctttttcctctgctgtaaatgttcgtctcattcaaaaaacctccgcaaccccatgttttcacataactgttgcgttgaccaattgaatctacagttgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactttttagagtaacgttgggtttttctgctcattattagctccttctgatgccattctatttcaggaaggagtgtccgttaaactcaggctacctcaggaaaaaccgtcctgaaaaaccagacggcagacgggctgtattacgcagtcaggtacttgagctacatggcatcagccacggttcggccggagcaagaagcatcgccacaatggcaacccggagaggctaccagatgggacgctggcttgctggcaggctcatgaaagagctggggctggtcagctgtcagcagccgactcaccggtataaacgtggtggtcatgaacatgttgctatccctaactaccttgaaaggcagttcgccgtgaccgagccaaatcaggtgtggtgcggtgatgtgacctatatctggacgggtaagcgctgggcgtacctcgccgttgttctcgacctgttcgcaagaaaaccagtgggctgggccatgtcgttctcgccggacagcaggcttaccatgaaagcactggaaatggcatgggaaacccgtggtaagcccgtcggggtgatgttccaagcgatcaaggcagtcattatacgagcaggcagttccggcagttactgtggcgataccggatcaggcagagtatgagtcggcgtggaaactgctgggataacagcccaatggagcgcttcttcaggagtctgaagaacgaatgggtgccagcgacgggctatgtaagcttcagcgatgcagctcacgcaataacggactatatcgttggatattacagcgcactaagaccgcacgaatataatggtgggttaccaccaaacgaatcagaaaaccgatactggaaaaactctaacgcggaggccagttttagttgaccacaacagactacctgaagggagccgcggtcgcctggcagttgcagtagcaggagatcatccagccgcagtacaggtcacgatgactctggttaatgataccggctttgaccccgtattttccggctctatcgctgaatcatggcgtcagcagccgtgcacaccatcctattgttgtgactgggaggctgccaccatgcttcgcgctttccctctggcgaaaaagggagaaggacgggcccgtctgccttcactttatgccagcttcggtaagctgggtgagacaccgactcatgaagatatcattgataacaatcgatccatcaactggcctgtataacgtggctgccggtgattaagaaagctgcacctacctaagtagtagcaaacgcacactttttagaaaaatcgatggtcagaaactggattagcaattccgttccatggttgcttttgatttacgttggcgtctgatcattgatttatcctcaaaagcccaacctcattggtaatgaaccagctccgtgaatgtccgctctggcacagagcgaaattttttgatctcccccctgaaatctaaacttagtcatgtcacgtttttgggtttctaaaattttaacttcgcgtttttcgttgccgtaagggttatacagaaatgtccgttaagcagagttcaaaattgattgccgtgatcacgactggtttgaaagccgcgcccaagcctgtacagctctggtttgcgttgattatgaacctgtcagcctaaagcaagcggatggacgatgagtattggtaatctttcagagtccggaaaagttcagccccagtctgaacaggcttgctggcgccagtccagtttcattcagtcgtggtttggttcttacggcctgtgcaatctacctcattaggcacatcggcctgccagataccggctcggggtgtatttccgcttccacgctgaatactgttctcagcaatcctggggtcatcacctcttctggtgtgccttgcgccataacatgtccgtttgccattaccaccagttgatcgcagtaccggctagcctgattaaggtcgtgcagcacagcgaccaccgttttcccctgagtccggagttcgcccatcaaccgcatcaggtccacctggtgattgatatcaagataggtggttggctcatcaagtaatacaacgggcgtattctgggccaggaccattgccagaaatgcgcgctggcgctgaccgccggaaagctcggttaaccgacgaacggcaagatgattgatccgggtctggttcatggcgacattaactcgtgcattgtcttcagcggagagacgcccccagagtgacagccagggattacgaccatacgaaaccagctcctggactgtgatcccctctggcgttaaatggtgctgaggcagcagcgaaagcctgcgggccaactggcgcgatgagagcatatttatgggattatcgccgagaaatacggtgccagactgcggcattaaaagccgcgaaaaacagtttaacagcgtcgatttcccgcaaccgttaggaccgatcagggcggtgatcttccccgttggcagtgagagtgaaacgtcgttaagtaccttgtctgtcccgtaactgaccgtcagattttcagttcgtaaagtcatttatcgcattctcacaagcaaccagacaaaccacggcgcaccgataatggcggtcagcacgccaaccgggagctccagtgggggatgaataattctcgccagcagatcggcaaccaccaacagcaacgcacctgtcagggccgaaacaggcagcagtctgcggtgacgtccaccggtgatgctacgcatcatatgcggcaccacgagaccaataaagctaatcgggccgcaggcggccacgccggtagatgtcatggcgacagctagtaacaaagcccagaatcgggtatggggcaccgacacaccgagcgtggtggcgcgcgcatcgccgagtgcaaggaggtcgagatcgcggcaaaaactcaggctcagcggcagaaataaaatcatcagcgggatggcaatcttcacaaagctccagtcacggccccataagctgccggtcagccacagcagggcgttgttcacatcctgcgggcgcgagagcatcagataatccgtcaggctggcccagcatgcagaaagcgccacgccggtgagcgccagcttcatcggctggtgggtctttgccagcatcttcagcaatatcaaccccgccatgccgcccgcaaaggccagcagcggcagcaccatcacgggcagtgacggcataagaagtagagcccccacagaggccaggctggcggcatggttaacaccgagaatatccggtgatgccagagggttgcgcacaatcccctgtatcagcacgcccgccacggcgagggctgcaccgacaaacagtgccagcagcaagcgcggcagtcggtactccatcaatacataataatgctcgtgtccggcctgccagtcggtcagcagcgcgcgccacggcacggggatcactcccatatggagtgataacagcgcacagcccgccagggcaagggtgatgaaaataaccagcgcaattttcatcctcgcctcctcacaagccagacaaagcaagggctgccaatcagcgccagcactgcgcctgcgggcagatctccggggaaggccagcgcgcgtgcgagtacatctgccagcagcatcagcgtggcccccagcagcatgctcactggcagtacgttgcgctgatcgaagcctgcccagaagcgcgccagatgtggcaccagcagaccgataaacgccaccggacctgctacgctgacgcacgcaccaaccagaagcagcactaacatattgatgaccaaacgtagcctcgtcaggttcactcccagcgtatgggcggtgctgtcgctgaggttgagcaggttcagttgattcgccagcagcaacacgacagggactgcagtgaccaccaccggcaagagctgccagacatcctgccagcgggcgtgggacactccgcctgccagccagtaaaagatgccgtaagcatgatcttcggccagcagcagggtgatgcgggtaaggcccatacaaaaggccgacagcgcgatacccgcgaggatcagtttgtttctgtcatgggtatgacgaaatccgcctcctgcggtcatgaccagcagccagctcacgccgcccccgcatgccgcgatgaatgacagagaatagcctgcaatcggcgtcggactcagcgcgctggtaagcgccatagccagcgccgcgccgctgttaatgccgagcagtgaaggagaggccattgggttgtgggtcagggtttgcagcagcgtgcccgcgagcgccaggcttgcgccgatcagaacggcgaccaggcttcgtggcaaacgaaggttttgcaccagcgcttctggtagcgttggcgtgtgtccaggcagcagggcgcgggttgcatctgctccggaaacaggaatggccgagtagcaaaacagactcagccagaaaataataataagtgctgcaacgggaagcccccacagcagcaccgggtgttttatcgcggtcatttcacaacggtaagcggctgatggtggaagatttttaccgtgtcagcggcaatacgctctgcagcaaaaataccgcgcatccgcgcccaggtgttactgtcgaccgaagcaacctgctgcttctgcgcggcggttaacatctgccagagcggatcttgttgccagcgtttaacaatgctctcttcgcgatagtgggcaaccagcagccaggcaggattgaccgccagcagttgctccaggccgatggacggcatggacgcacccgccatcgcagcgggaacgttcagccccagagaggccagcacgctgccggtccaggtctcctgagtatgcaggttgaattgctgttcgcgtgatgtgccaaaggccacgcgtgtccctttgggaagctggctggcccactgcgccatcctctctttatgttgttccagacgtgcctgcatctctcgctttttacccaccatttcgccgatgatagccgcagattgcaaattttcagcgtaggtttcgttgcgggacttaagcagcagtaccggcgcgatttgctgcaaggcgatgtaaacccccgcatggcgactgctgtcggcaatgatcaggtctggtttcagagcggcaatggcttccaggctcggctgcgcgcgcgttccgacggactgccacggtttcaggtgcgcacgcacttcgggcaggatgcgttttgcatcgttatcgtcggcaataccgatcgggatgacgtccacggcggccagcgcatcggcgaacgagagttccagcaccacaatccgttgtggcgttttttcgagtgtaaacgtgccgtgttcgtcctgaaccgtggcggcaaaggcgtggctgatcaccagcagcaggcctgcaaaaagaaaacggataaatgccaacataatcacattccagctaaaagcccggcaagccgggcgttaacacatcagaacttcaacgacccctgcatatacagcgtgcgcggctggcctgcatagatgcctttgttgttgtcgtcataagagcggatgaagtagtcctggtcgaagatgtttttcacaccgaatgccaggttcagatctgccatctgcgggccaaagtcatacgccacgcgtgcgccccagagcatgaagccgggaatgcggccggtactgccgtcggcgctctctttcaccgtattggcgttatccgcaaactggctggactggaaatcgctgttcagattgaacgtccagtttcctggcttgtagtccacgcccagcgtgcctttatgtttcggggagaatggtaccagattgccgtaggtgtcgcctttctcgcggatttccgcgttcacatacgcatagctggcgtagatggaaacgttatcaagcgttggcgttagcgtacccagatcgtaacgtgcctgcgtttccagcccggtatggcgcgttttgccacgtgcagtgacggtgtcgttggtctggttggagtcgtactgattgttaaagttaatcaggaacagccccatttccgccgtcagcgcgccgtcgtcgtagcgggtaccgagttcccaggttcgcgctttttccggttcaacattgccgctttgcacagccttgccaatctggctgtactgtacggtgccgaacgagccttcagtgtttgcataaagattccagctgtcagtcaggtgatagagcacgttcaacgccggaagcggtgcgttatagctcacttcttcgtgcgtgcctgtgatggcgttgttctggtatgactcgatatgttcgaaacgcatacccggcgtgatggtccagttgccgatgtcgattttgtcatccagataccaggcgtgcgcctcggtgccggaacgcgtatcgcggtcgtaagggcttgagccggacggcaactgcccgctgctggtggcggtgtagtaacgcatttcatgcgttgattcattcaaatagcgatagcccacgcccacttcgtgcgcggaagggccgatcataaagatctggctgtagcgtggctcaataccgcgcacccagtagttacgcggcgagagggtgatgcgtttgccttgctccaggtagccgctgcgcagggtttgggtgtagaacccctgaatgttgaatttatgctggctgtctggctggaactggtagcccaggctcgccagcttgcgacgaccccagaagcggtcatacgggcgggtggattgccagcgatcggcgtcgtaatccgcgcgagacaggccaccgggcatgtcggcttcaccgtcgtaatattgcagcaggctgttgaaggtgtgcacctcatccggcgcatatttgcttttcagcatcaggtcgtcgatgcgggtggcgctgtgctcgcgccagtcactgccgcgcgtgccggagtagagcagcgcggtgccaaaaccgttgtccgctgtgccgcccaccatcaggttgtgcgtctctttcgggttgttttgtgaagaggttgggctgagctgaccttccacgcccgcctcgataccaaagtcctgcggaatggcacgggtaacaaagttcaccacgccgcccacgctctgcggtccgtaacgcaccgcaccaccaccgcgtaccacgtcaatggcatccatgttgccgagcgaaacgggagccagtgaaagctgcggctgaccgtaaggggcgaaggggacggggatgccgtccatcaggacggtcgagcggctggcgaggcgcgggttcaggccccggatgccaaagttcatcgccaggtcgtggctgccggtgccgttgttttccggcgcgctgacgccagggatgcggttaagtacctcacgcatggtggttgcgccggttttggcgaaatcctcacggcggatcacgtcacgcgcgccagcatgttcaaatacgtcgttttcacgcgcatcacccagccagtcgccgaccacggtcagggcatcttcttttggtgcgggcgcgggctccagcgtccagctgttatttcccagcggttttacctgcagtccgctgccgtccagcagttgttgcaggccgctctcgacgtcgtaatcgccgtgcaggccgttgctctgcttgccgcgcgtcaggctggcgtcaaccgagagggtaaatccgctgtgtgcggcatactgattgagcgctttatcgagcgatcccggtgcgatattaacctgtgcagcaaaagcggaaaacgagagaccggccagcggcagcaggctcaggcgaatggtgttaaccaaaggtgttgttttacgaaaaacgcgtaacggcgtcataccttccccatcatcatttttgttgtgttcagctatgagtcgaacgagaagggtaaaaaggacaatcgaaa

SEQ ID NO: 9 - protein, 318 aa, Artificial Sequence
  Description of Artificial Sequence; note = synthetic construct
MRLAPLYRNALLLTGLLLSGIAAVQAADWPRQITDSRGTHTLESQPQRIVSTSVTLTGSLLAIDAPVIASGATTPNNRVADDQGFLRQWSKVAKERKLQRLYIGEPSAEAVAAQMPDLILISATGGDSALALYDQLSTIAPTLIINYDDKSWQSLLTQLGEITGHEKQAAERIAQFDKQLAAAKEQIKLPPQPVTAIVYTAAAHSANLWTPESAQGQMLEQLGFTLAKLPAGLNASQSQGKRHDIIQLGGENLAAGLNGESLFLFAGDQKDADAIYANPLLAHLPAVQNKQVYALGTETFRLDYYSAMQVLDRLKALF

SEQ ID NO: 10 - DNA, 10707 bp, Artificial Sequence
  Description of Artificial Sequence; note = synthetic construct
gtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctacgaaccaacattgatccgcacggtactgcgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatggtcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaaattaatattatttataaacccataattacagaaaataattatgggttttttatttgtttgatttataggtttgatgaatatttctcttaaatagagtgaatgttgcattcagtggaaggaatttacaaacttcagcttcggataattatcaccaactggtaaagtgagcgccgtggagatttccccctattggactcattttcaggttataccccatgtcatcactgaatattaaacagggaagtgacgctcattttcccgattatcctctggcgtcgcccagtaataatgaaattgatttacttaatctaatctcagttttatggcgggccaaaaaaacggtcatggcggtcgtttttgcgtttgcctgcgcaggcttgctgatctctttcatcctgccgcaaaaatggaccagcgcggcggttgtcacgcctccagaacctgttcagtggcaagagttggagaaatcattcactaagcttcgtgtgctggatctggatatcaaaattgatcgtacagaagcatttaacctgtttatcaagaagtttcagtcggttagcttgctggaagagtacctgcgttcatcaccttatgtgatggaccaattaaaagaggcgaaaatcgacgaactggatttgcatcgcgcaattgtcgcattgagcgaaaaaatgaaagcggttgatgacaatgccagtaagaaaaaagatgaaccgtcactgtatacctcctggacgctaagttttaccgcgccaaccagtgaagaggcgcagaccgttttgagcgggtatatcgattatatctctacgttggtggtgaaagagtcgctagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtttacagtaatggtcaggccgttaaagatgaccccgatttttctatttctctcggtgcagacggtattgaacgcaaactggaaatagaaaaagcggtcactgacgttgcggaactgaacggtgaattacgtaatcggcagtatcttgtcgagcaattaacaaaagcacatgtcaacgatgtgaattttacgccgtttaaatatcagttaagcccgtcattgccagtgaaaaaagacggtccgggtaaggcgattattgtgatcctttccgcgttgatcggcgggatggtggcttgtggtggcgtgctgttgcgctatgcgatggcatccagaaaacaggatgccatgatggcagaccacttagtttaactatttgcggttgaaggtgccgttcgtccgagcggcaccacaagcggcgttccggcaactggatcgtcaatgatcatgcagcgcagaccataaatgcgctcaatcagttcagcagtgacaatctccttcggcgctccctgagcaacaattttcccttcccgcaatgcaatcaaatggctggcgtaacgacaggcctgattaagatcgtgcagcaccgccgccagggtatagcctttttcgcggttcagttcgcttaacaactccagcaaatcaatctgatgactgatatccagccaggtcgtgggttcgtcgagcagcataattgccgtttcctgggccagcaccatcgcgatccacgctcgctggcgttgtccgccagaaagggtatccacgctttgatctgccagatgagttattcccgtggcctgcattgctttcgttaccgcttcttcatcctctttgcgccagcgggtaaacagcggttgatgcggataacgtccacgcgccaccagctcctgcacggtgatatcgcccggcgtggtagcattttgcgccaacagaccaatccggcgtgcaacctctttactggcgtaatgttgaatgtgctcgccatccagccagacatgcccatgagcaggcgtcatcaggcggcttaaggtacgcagtaacgtggatttaccgcagccatttggcccgataattgccgtgaagtgaccatcaggtatttctacagtcagattttccgcaacggtatatttgccatatcccagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccgccagcagtaacagcgccccgcatagcgccgcctgggttagcccccagcgagcggtgccgctaatgcgtcgggcaatgtgcggtgcgactaaagcaataaaggaaatcggcccggcaagcgctgttgccgcagcggtaagcaccactgcaaccagcatcattaacagacgcgaacgttcgacgctgacgcccagcgcacacgcggtatcatcgcccatttccagcaagcgcatccggcgtaccagtaaggcggcggcaatgagcatcaatataatgatgggtgcggaaggcgaggtttttgcccacgtcaggccgttgagcgatccggcattccacaaacctgctgttagcgccgtttctaaagacgctttcagcaacagccaggtattaaaggccaccagcatggcgcgaacgccgataccgataataatcaaccgaaaggtgtcgatgccgttgcgccaggcgagcagccagaccagcagcgaagtgacaatgccgcccaccattgctgacagcgcgatagccgtcaggtcctgaccaaacagcaccatcgccaccagcacgccgctccacgccccggtgttaaagcccattacgtcagggctgccgagcgggttacgcatcagcgactgaaaaatcgcgccactgacgcccagtgctgcgccaatcaacagcgccatcagcacgcgtggtaaacgccattcggtgaccaccatcgtcatactgcgcggcgcatcgcccatcagcgcggcgaatacctgcgaggtttccagcgtgacggcaccgctgcgtaatccccagatacctgcaaccacacaggcggaaaccagcagcaaacaggtgatgagtaatcggcgagagacgtaaatcatgcaccacctcgcgttttacgtcgcacgaggaagatcagcaccggtgcaccaataaacgcactgaccacagaaacgcgcagttcgccgggcacaatcacccgcccgatgatatcggcaaacagcagcagggcaggggtagcaagtagcgtgacgggcagcgaccagcgatgatcggcacccaccagccaacgcgccatatgcggcatcatcaggccaataaaggcaatcgggccaactattgccgtcgcactaccacaaagcacggtaatcgccagcagaccaatcaactgtgtgcgcgccacgcgactgcccagcgccgtcgcggtgtcgctgccgaggctcaaactgttcagcgcgcgactcagtaatagcgcagttgctccggcgatcagcaccgggatcagcaccacttttaaggtatgtagattgcgaatatccagcgaaccggcttgccagaaacgcaactgatcgtagacgtcaggattaagcagggcgatgccgctggtcagtccttccagcaccgccgccagcgccacgcccgccagggttaaacgcaccggacttaactgcccgccgccctgactgccggtaaaggcaacaatcaatgaggccaccagcgccccggcgaaggccatcgccagttgttcctgcgcggaagagtaaccaaacagcgccgcacccagcacaatggcaaagctggctccggcgttcacgccaagcaagccggggtcggcaagtgggtttcgggtgagggtttgcattaacgccccggcaaggccaagcgcgccgcctgccagtaaaccggcaagggtacgcggcagccgcgcgtcgagcacgatggtgcagtcggcgctctggcaggtgccggagaaggcctccagcactacggaagcggggagtgattttgccccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgtttcatctcaattgtgtctctgggtttgctcggcgtcgcggtgccggtgcagatccagatgatgacacattccacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgccttaatgcactgctgccggagccgtcattgctggcaatctatttacttggtttatgggatggttttttcgcatcgcttggcgttacggcgctattggcggcgacaccagcactggtagggcgtgaaaacttaatgcaggccggggcgatcaccatgttgaccgtgcgtctggggtcggtgatttcgcccatgattggcggtttattgctggcgaccggtggcgtagcctggaactacgggctggcggcggcgggcacgtttattaccttgctaccgttgttaagccttccggcgttgccaccgccaccgcagccgcgtgagcatccgttgaaatcattactggcaggatttcgttttctgcttgccagcccgctggtgggcgggattgcgctgctgggtggtttattgacgatggcgagcgcggtgcgggtactgtatccggcgctggctgacaactggcagatgtcagcggcacagattggttttctctacgcggcgatcccgctcggcgcggctattggtgcgttaaccagcgggaagctggcacatagtgcgcgaccagggttattgatgctgctctccacgctgggatcgttcctcgccattggtctgtttggcctgatgccgatgtggattttaggcgtggtttgtctggcgctgttcggctggttgagtgcggtcagctcgttgctgcaatacacaatgctgcaaacgcaaaccccggaagcgatgttagggcggattaacggtttgtggacggcgcagaacgtgacgggcgatgccataggcgcggcgctgctgggtggtttgggcgcgatgatgacaccggttgcttccgcaagcgcgagcggttttggtttgttgattatcggcgtgttgttattgctggtgctggtggagttgcgacattttcgccagacgccgccgcaggtgacagcgtccgacagttaatgcttaaaacagcgccttaagcctatccagcacttgcatggcgctgtagtaatccagacggaacgtctcggttcccagcgcataaacctgcttgttttgtactgcaggcaggtgcgcgagcagcggattagcataaatagcatcggcatctttctgatcaccggcgaacaggaatagtgactcgccatttaaccctgcagccagattttccccaccaagctgaatgatgtcatggcgtttaccctgactttggctggcatttaaccctgcgggtaacttcgccagcgtaaagccgagttgttccagcatctgcccttgtgctgattctggcgtccagagattggcactgtgtgcagcggcagtatagacaatggcagtgaccggctgcggcggtaatttgatttgctctttcgccgccgccagttgcttatcaaactgcgcaatccgctctgccgcttgtttctcatgcccggtaatttcgccaagttgcgttaacagcgactgccagcttttgtcgtcgtaattgatgattaatgtcggggcgatggtggaaagctgatcatacagtgccagcgccgaatccccgccggttgcgctaattaaaatcagatccggcatttgcgcggcaacggcttcggcgctcggttcgccgatatagagccgttgcagtttgcgttctttcgccaccttgctccactggcgtaaaaagccctggtcatccgcgacgcggttattcggcgtggtcgcgccgctggcgatcaccggagcatcaatcgccagcagtgagccggtcagggtgacgctggtggaaacaatacgctgcggctggctttccagtgtatgtgtgccacggctgtcagtaatctgacgcggccagtcagcggcctgaactgcggctattcctgaaagcaaaagtcctgttaatagaagggcgttgcggtagagcggggcgagtctcacaaatcagcttcctgttattaataaggttaagggcgtaatgacaaattcgacaaagcgcacaatccgtcccctcgcccctttggggagagggttagggtgaggggaacagccagcactggtgcgaacattaaccctcaccccagccctcaccctggaagggagagggggcagaacggcgcaggacatcacattgcgcttatgcgaatccatcaata

SEQ ID NO: 11 - protein, 296 aa, Artificial Sequence
  Description of Artificial Sequence; note = synthetic construct
MSGLPLISRRRLLTAMALSPLLWQMNTAHAAAIDPNRIVALEWLPVELLLALGIVPYGVADTINYRLWVSEPPLPDSVIDVGLRTEPNLELLTEMKPSFMVWSAGYGPSPEMLARIAPGRGFNFSDGKQPLAMARKSLTEMADLLNLQSAAETHLAQYEDFIRSMKPRFVKRGARPLLLTTLIDPRHMLVFGPNSLFQEILDEYGIPNAWQGETNFWGSTAVSIDRLAAYKDVDVLCFDHDNSKDMDALMATPLWQAMPFVRAGRFQRVPAVWFYGATLSAMHFVRVLDNAIGGKA

SEQ ID NO: 12 - DNA, 12888 bp, Artificial Sequence
  Description of Artificial Sequence; note = synthetic construct
ataaatagcagatgcttttccggatagcaattatctaaacgtaacacttgacaactgtgtgaggaaaagcgtatttgcgcacgcgaccagaatgtaaattaaccagttacttactttactacaatgtaaccggcagtgattttttaagagccatgccttcagcagaaatttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttctgcgccgtattttacttcgcttttcagcgagctatagcctgacagttctgaaattgattcattaaggatagcctctttcgtcaacctgttagcccaaagcgtgttgacgcaaataaatgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgcatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgacgcatccctaaccacaccacacgcgaacgcagccattgtccggcgtcatcaagcgtgagtgtgaaaccaggttgacgaatccgtccggctaaaagagaaagcgccttctctttctcggcgctcacttcgcctaaaaatgccagagtcagatgcaaattatcggcggcgaccggacgtcccgcctcaggtgggaagtgtgtggcgcgccaatggataatctgttcgcggatttctgcaggtaagtcgatagcaaagaacagacgttgcggttcagacatgtgaggcactcggttatgaattaccgcgatgctacaatgtggcgcgaagaatgttaaccctctggagcgttttgtgtcgtcgttgcccgttgctgccgtcttacctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatcagcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgtggcggtgaggcagacagttcgcttatcgcgccgctacttgccggggcgtttgccgatcgcattgctcgtcgccgtgggcaagatggacgctatcaactggcaaacggcatgggagcgatgctcgatgccaacgacgcgctaagccgccacgaatggttgatcgcaccgttattattgcagggcagcgcctcgccggatgcgcggattttactggcgctgctggtcgatattgatgagttagtacaacgctgcccgcagctggtacagcagtctgacactgtggagtgggatgacgcgcaaggtacgctgaaagcctggcgtcggctacaaatcggtcagttgacggtgaaagtgcagccgctggcgaaaccgtcagaagacgagttgcatcaggcgatgcttaatggcatccgtgataaaggtttaagcgtgctcaactggacggcggaagcggaacagctacgcttgcgtttgttatgcgccgcaaagtggttgccggaatatgactggccagcggttgatgatgaaagtttattggcagcgctggaaacgtggctgctgccacatatgactggcgtacattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaagagatgtttggcgaggccaccaatccgacgatcgcccaggggcgcgtgccgctggtgctggagttgctttcacctgcccaaaggccattacaaatcacacgagatttgagcgacttctggaaaggagcgtaccgtgaggtgcaaaaagagatgaaagggcgttatcccaaacatgtctggccggacgacccggcaaatactgcaccgacgcgacggacgaaaaagtattcgtaaggttggttttctccctctccctgtgggagagggccggggtgagggcatcagcgcgcacgttcaccctcaccctaaccctctccctcaagggagaggggaccgatcgagcacaaattttgagagatatcttcttctgtcttgtaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggccaacagcattgagatgattcgccgtccgtttgatttcccggacagtaaagaaggacaggtgcgcgcgcgtctgacctttgatggcgatcatctggcgacgatcgtcaatatggagaacaaccgtcagttcggtttcttccgtcttgatccgcgtctgatcaccatgatctcttcgccaaacggtgagcagcgtctgtttgtgccgcgcagtggtttcccggatttgctggtggatactttgctggcgacagaagaccgtcatttttacgagcatgatggaatcagtctctactcaatcggacgtgcggtgctggcaaacctgaccgccggacgcacggtacagggtgcgagtacgctgacgcaacagctggtgaaaaacctgttcctctccagcgagcgttcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcaagcttgtattactttggtcgcccggtagaagagctaagcctcgaccagcaggcgctgttagtcggtatggtgaaaggggcgtccatctacaacccgtggcgtaacccaaaactggcgctggagcgacgtaatctggtgctgcgtctgctgcaacagcaacagattattgatcaagaactctatgacatgttgagtgcccgtccgctgggggttcagccgcgcggtggggtgatctctcctcagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggaggttctgagccgcagtttgcgggctacaaccgtgcgatgcaggcgcgtcgttcgattggttcccttgcaaaaccagcgacttatctgacggccttaagccagccgaaaatctatcgtctgaatacgtggattgcggatgcgccaattgcgctgcgtcagccgaatggccaggtctggtcaccgcagaatgatgaccgtcgttatagcgaaagcggcagagtgatgctggtggatgcgttgacccgttcgatgaacgtgccgacggtaaatctggggatggcgctggggctgcctgcggttacggagacctggattaaactgggcgtaccgaaagatcagttgcatccggttccggcaatgctgctgggggcgttgaacttaacgccaatcgaagtggcgcaggcattccagaccatcgccagcggtggtaaccgtgcaccgctttctgcgctgcgttcggtaatcgcggaagatggcaaagtgctgtatcagagcttcccgcaggcggaacgcgctgttccggcgcaggcggcgtatctgacactatggaccatgcagcaggtggtacaacgcggtacgggtcgtcagcttggggcgaaatacccgaacctgcatctggcagggaaaacagggactaccaacaataacgtagatacctggtttgcgggcattgacggcagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggcatgcgtatcttgccggtctggaccagcgatccgcaatcgctgtgccagcagagcgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaacatctaagcgtgaaataccggatggcgagttgccatccggtaaaataacatcccatctaagatattaaccctttcttttcatctggttgtttattaacccttcaggaacgctcagattgcgtaccgcttgcgaacccgccagcgtttcgaatattatcttatctttataataatcattctcgtttacgttatcattcactttacatcagagatataccaatggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccggtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaatttctcttttggggcacggatttccgtgcccatttcacaagttggctgttatgcaggaatacacgaatcattccgataccacttttgcactgcgtaatatctcctttcgtgtgcccgggcgcacgcttttgcatccgctgtcgttaacctttcctgccgggaaagtgaccggtctgattggtcacaacggttctggtaaatccactctgctcaaaatgcttggccgtcatcagccgccgtcggaaggggagattcttcttgatgcccaaccgctggaaagctggagcagcaaagcgtttgcccgcaaagtggcttatttgccgcagcagcttcctccggcagaagggatgaccgtgcgtgaactggtggcgattggtcgttacccgtggcatggcgcgctggggcgctttggggcggcagatcgcgaaaaagtcgaggaagctatctcgctggttggcttaaaaccgctggcgcatcggctggtcgatagtctctctggcggcgaacgtcagcgggcgtggatcgccatgctggtggcgcaggatagccgttgtctgttgctcgacgaaccgacctcggcgctggatatcgcccaccaggttgatgtgctgtcgctggtgcaccgtttaagtcaggagcgtggcctgacggtcattgccgtgttgcacgatatcaatatggcggcacgctactgtgattatctggtcgccctgcgcggcggtgaaatgattgctcagggaacgcctgcggaaattatgcgcggcgaaaccctcgaaatgatttatggcatcccgatgggtattttgccgcatccggcgggtgctgcacctgtgagttttgtttattgatgagcggcttacctcttatttcgcgccgtcgactgttaacggcgatggcgctttctccgttgttatggcagatgaataccgcccacgcggcggctattgatcccaatcgtattgtggcgctggagtggttgccggtggaattactgctggcgctcggcatcgtgccttacggcgtggcggataccatcaactatcgcctgtgggtcagcgaaccaccattgccggactcagtgatcgacgtcggtttgcgcacagaacctaaccttgaactgctgaccgaaatgaaaccatcgtttatggtctggtcggcaggatatggcccttcaccagaaatgctggctcgtattgcgccgggtcgcggatttaacttcagtgacggcaaacagccgttggcgatggcgcgtaaatcgctgacggaaatggcagatttacttaacctgcaaagcgcagcggaaacgcatttagcgcaatatgaagactttatccgcagcatgaaaccccgctttgtgaagcgtggtgcgcgtccgttattgctgacgacgcttatcgatccgcgccatatgctggtcttcggtccaaacagcttgttccaggaaattcttgatgagtacggcatcccaaatgcctggcaaggggaaaccaacttctggggcagtaccgccgtcagtatcgatcgtctggcggcgtataaagacgttgatgtgctctgttttgatcacgacaacagcaaagacatggatgcgctaatggcaacgccgctgtggcaggccatgccgtttgtccgcgccggacgctttcagcgcgtacctgcagtctggttttatggtgcgacgctctcggcaatgcactttgtgcgcgttctggataacgccatcggaggtaaagcgtgagtaaacgaattgcgcttttcccggcgttattgctggcgctgttagtgattgtcgctacggcgctcacctggatgaacttctcgcaggcgctgccgcgtagccagtgggcgcaggctgcctggtcgccggatattgacgtcatcgagcagatgatttttcactacagcttgttgccgcgtctggcgatttcgctgctggtgggcgcgggtctggggctggtgggcgtgctgtttcagcaagtgctgcgtaacccgctggcggagccgacgacgcttggcgttgctacaggcgcgcaactggggattaccgtcactacgctctgggcgatccctggtgcgatggcgagccagtttgctgcgcaggcaggggcttgtgttgttggcttaattgtctttggcgtcgcgtgggggaaacggctgtcgccggtaacgctgattctcgcggggttggtagtgagcctttattgcggcgcaatcaatcagttactggttatcttccatcatgaccaactgcaaagcatgtttctgtggagcactggaacgctgacgcaaaccgactggggcggcgttgagcgtttatggccgcagctgctgggcggtgtgatgctgacgttgctgctacttcgtccgttaaccctgatggggcttgatgatggcgtggcgcgcaatctcgggctggccttgtcgcttgcgcgtctggcagcgctgtcgctggcgattgtcatcagtgcgctgctggtgaacgctgtggggattatcggctttatcgggttgttcgcgccgctgctggcaaaaatgctgggggcgcggcgtctgctgccacgactgatgctggcgtcgttgattggtgcgctgatcctctggctttccgatcaaatcatcctctggctgactcgcgtgtggatggaagtgtccaccggttcggtcactgcgttgatcggtgcgccgctgctactgtggctgttgccgcgtttacgcagcattagcgcgccggatatgaaggtcaacgatcgtgtcgcggctgaacgccaacatgtgctggcgtttgccctcgcgggcggcgtgctgctgttgatggctgtggtggtggcgctgtcgtttggtcgtgatgcgcacggctggacgtgggcgagcggggcgttgctcgaggatttaatgccctggcgctggccgcgaattatggcggcgctgtttgcgggcgtcatgctggcggtggcgggctgtattattcagcgactgaccggaaacccgatggcaagcccggaagtgctggggattagctccggcgcggcgtttggcgtggtgttgatgctgtttctggtgccgggtaatgcctttggctggctgttacctgcaggcagtctcggcgcggcggtgacgctgttgatcattatgatcgccgccggccgcggtggattttccccacaccgtatgttactggcggggatggcgttaagcaccgcgttcaccatgcttttgatgatgttgcaggcaagtggtgacccgcgaatggcgcaagtgctgacctggatttccggttcgacctacaacgcgaccgatgcgcaggtctggcgcaccggaattgtgatggtgattttgctggcgattaccccgctgtgccgccgctggctgaccattttaccgctgggtggtgataccgcccgagccgtaggaatggcgctgacgccgacgcgaattgcgctgctgctgttagcggcttgcctgacggcgaccgcgacgatgactattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatcccggcggggctgctgtcaacctttatcggcgcgccatattttatctatttgttgagaaagcagagccgttaatttttccatataacggccctgtacgcctggacggataaagcgtttacgcgacaacggatgcccgatgcgacgctggcgcgtcttatcgggcctacaaacggccccga

SEQ ID NO: 13 - protein, 257 aa, Artificial Sequence
  Description of Artificial Sequence; note = synthetic construct
MARKWLNLFAGAALSFAVAGNALADEGKITVFAAASLTNAMQDIATQFKKEKGVDVVSSFASSSTLARQIEAGAPADLFISADQKWMDYAVDKKAIDTATRQTLLGNSLVVVAPKASVQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTIK

SEQ ID NO: 14 - DNA, 10934 bp, Artificial Sequence
  Description of Artificial Sequence; note = synthetic construct
tcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacacccgttgggcggctgatattcatatcaccccggatggtcgccatttatacgcctgcgaccgtaccgccagcctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatattctcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatg

SEQ ID NO: 15 - protein, 396 aa, Artificial Sequence
  Description of Artificial Sequence; note = synthetic construct
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 16 - DNA, 14674 bp, Artificial Sequence
  Description of Artificial Sequence; note = synthetic construct
acgggtgggcgcagagcgatacttcgctactattttcacccagaagtgctccaccacttgcgaaacgcccgactgcgaacgcttctggtgacaacccaggggattcagcccctgtagccgatgatgaacgtggccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgatggggtcatgcggatttttcatccactcctggcggtcagtagttcagctaataaatgcttcactgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaggatctggcgaaagagtgcgatctggcgggcgcgattaagtcgatgttctctggcgagaagatcaaccgcactgaaaaccgcgccgtgctgcacgtagcgctgcgtaaccgtagcaataccccgattttggttgatggcaaagacgtaatgccggaagtcaacgcggtgctggagaagatgaaaaccttctcagaagcgattatttccggtgagtggaaaggttataccggcaaagcaatcactgacgtagtgaacatcgggatcggcggttctgacctcggcccatacatggtgaccgaagctctgcgtccgtacaaaaaccacctgaacatgcactttgtttctaacgtcgatgggactcacatcgcggaagtgctgaaaaaagtaaacccggaaaccacgctgttcttggtagcatctaaaaccttcaccactcaggaaactatgaccaacgcccatagcgcgcgtgactggttcctgaaagcggcaggtgatgaaaaacacgttgcaaaacactttgcggcgctttccaccaatgccaaagccgttggcgagtttggtattgatactgccaacatgttcgagttctgggactgggttggcggccgttactctttgtggtcagcgattggcctgtcgattgttctctccatcggctttgataacttcgttgaactgctttccggcgcacacgcgatggacaagcatttctccaccacgcctgccgagaaaaacctgcctgtactgctggcgctgattggcatctggtacaacaatttctttggtgcggaaactgaagcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtattcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgataaagaaatcagcagccacgatagctcgaccaatggtctgattaaccgctataaagcgtggcgcggttaatcatcgtcgatatgtaggccggataaggcgttcacgccgcatccggcaaccgatgcctgatgcgacgcggtcgcgtcttatcaggcctacaggtcgatgccgatatgtacatcgtattcggcaattaatacatagcacgattgattaaataaccttaataacaatgccgacgttatgtcggcatttttttatcagataaatccccttgtctgtaatttaacggaaatcataccgtgaggttaatcctaaaatagatttttaatcgttgtttatttcggaaaatacgcagattaattgcttttgtttttattttaagtttatgatttttattgttatttaaatataagttgaaacttatatttgatattcattccaattatcctaaaacgccatcgctaattccccgcgccgtaattcgcatgctttagttgtgtatactcgatcccgcccgaaatgtttttgggtaaatctccattcattcaatgaagggaaattgttatgaaaaaagttctgtatggcatttttgccatatctgcgcttgcggcgacttctgcgtgggctgcacctgtacaggtgggcgaagcggcagggtcggcagcaacgtcggtttcggcggggagttcctccgcgaccagcgtcagcaccgtaagctcggcggtgggtgtcgcgcttgcggcaaccggtggcggtgatggttctaataccgggaccaccacaaccacgaccaccagtacccagtaataaagtatgtatccccaaaataattcgagtcattgcatctgtggctagaagtatgaagggattaaccataaccacactccggtgtggttattctgcccctctggagaagagtcgtgaagcgacctgcactcattcttatctgcctgttattacaggcctgttcagccacgactaaagagctgggcaattcactgtgggacagtctgttcggcacgccaggcgtacagctgacggatgatgatattcaaaatatgccctacgccagccagtacatgcagcttaatggcgggccgcagttatttgtggtgctggccttcgctgaagacggacaacaaaaatgggtcactcaggatcaggctactctcgttacccaacatggccgtctggtgaagactctgctcggcggcgacaacctgattgaagtgaataaccttgctgccgacccgctgattaaacccgcacaaatcgttgatggcgcaagctggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattattttccggtgaaaaccactctcatcaaggcggcaaaacaatgattaaacaaactattgtcgcgttgcttttgagtgtgggagcgtcatcggtcttcgcggcaggaaccgtcaaggtgttcagcaatggcagcagtgaggccaaaacgctaacgggcgcagagcatttaatcgatctggtaggccaaccgcggctggcaaacagctggtggcccggtgcggtgattagcgaagagctggcaacggcggcagcattgcgtcagcagcaggcgttgctgacacggctggcagaacagggcgcagattccagcgccgacgatgccgctgcgattaacgccttacgccagcaaattcaggcgttgaaagtgacgggcaggcaaaaaatcaatcttgatcccgatatcgtccgcgttgccgaacgcggtaacccgccgttgcagggcaactacacgctgtgggtcggaccaccgccgtccacggtcacgttgttcgggcttatcagccgtcctggcaagcagccattcactccaggtcgcgacgtggcgagctatctctctgaccagagcctgctcagcggtgcggatcgcagctacgcgtgggtggtttacccggacggacgcacgcaaaaagcgccggtggcttactggaacaagcgtcacgtagagccgatgcccggcagcattatttatgttggcctcgcggactccgtctggagtgagacgcctgatgcccttaacgccgacattcttcagactctgacgcagcggatacctcaataatgaaaaaaagacatctgcttagcttactggcgctgggcattagcacagcttgctacggcgaaacatatcctgcgcccattggtccgtcgcagtcggatttcggtggcgtaggattattacaaacgcccaccgcgcgtatggcacgggaaggggagttgagtctgaactatcgcgataacgatcagtaccgttattactcagcttcagtgcaactcttcccgtggctggaaacaacgctgcgctacaccgacgtgcgcacccggcagtacagcagcgtcgaagcgttctctggcgatcaaacgtataaagataaagccttcgatctcaaactgcgtttgtgggaagagagttactggctgccgcaagtggcggttggtgcgcgggatatcggcggtacggggctgtttgatgcggaatatcttgttgccagcaaagcctgggggccgttcgattttacgctcggcctgggctgggggtatttgggcaccagcggtaatgtgaaaaatccgctctgttcagccagtgataaatattgctatcgcgataacagctacaaacaggcgggatctatcgacggtagccagatgttccacggtcctgcctcactgtttggcggcgtggaataccagacgccctggcaaccgctgcgcctgaaactggagtatgaaggcaataattatcagcaggattttgccgggaagctggagcaaaaaagtaagtttaacgtcggtgcgatttatcgcgttaccgattgggccgacgttaaccttagctatgaacgtggcaacacctttatgtttggcgttacgttgcgcaccaactttaacgatctgcgcccgtcttacaacgataacgcccgcccgcaatatcaaccgcagccgcaggatgccattttgcagcattcggtggtggcgaatcagttaacgctgttgaaatacaatgccggacttgccgatccacagatccaggcgaaaggcgatacgctgtatgttaccggcgagcaggtgaaatatcgtgattcgcgcgaagggatcatccgtgcgaatcggatcgtgatgaacgatctgccggatgggatcaaaacgatccgcattacggaaaatcgccttaacatgccgcaggtgacgacggaaaccgatgtcgccagcctgaaaaatcatctcgccggagagccgttgggccacgaaacgacgctggcgcaaaaacgcgtcgagccagtggttccgcagtccaccgagcagggctggtatatcgacaaatcacgctttgatttccatatcgatccggtgctgaaccagtcggtcggtggcccggaaaacttttacatgtatcagctgggcgtgatgggaacggcagatttgtggctgacggaccatctgctgaccaccggcagcctgtttgcaaatcttgccaacaactacgacaagtttaactacactaatcctccgcaggactcgcacttaccgcgcgtgcgtacccatgtgcgcgagtatgtgcagaacgatgtctatgtgaataacctgcaagccaactacttccagcatctgggcaacggcttctacggtcaggtctacggtggttatctcgaaaccatgtttggcggtgcgggggcagaagtgttgtatcgcccgctggacagcaactgggcgtttggtctggatgccaactacgttaaacagcgcgactggcgtagtgcaaaagatatgatgaaattcaccgactacagcgtgaaaaccggacatctgaccgcctactggacgccatctttcgctcaggatgtgttagttaaagccagcgtcgggcagtatctggcaggggataaaggcggcacgctggagatcgccaaacgctttgatagcggcgtggtggtgggtggctatgccacgatcactaatgtttcgaaagaggagtacggcgaaggggacttcaccaaaggcgtgtatgtctcggtaccgttggatctcttctcgtctggcccgacacgcagccgtgcggcgattggctggacgccgctgacgcgtgacggtggtcagcaacttgggcgtaagttccagttgtatgacatgaccagcgaccgtagcgtcaatttccgctaagtcatgggaaaggtgccagttttcgcactcactggcaccttcattcttaatggcctgtcgagccatcaggaacgcagttcactcccggtttgcgatctggtgtgtaaaggcgaaaacattctgtcttcctgtccgtcgatatcggttgcaggtctggttgcctgagcgactgggccatcattgggctggagacattgctttgcggtaggtcggctttatcagcagtaccgagcggaccagcataagcaggaagaacagagactgataacatcaaagcagcaaaataaggcttcatttttaccacctttatcaggttacgtttcatttgttccagaggaacattgtcgatttttcgcgcattgctggtggctgggaatcacctgaatgggtgatttttgaattaccggctttggtgcggtttgtcttgccggatgcgccgccaggcgcggcttatccggcctacgggtaggtatatccggctttggtggaggcgcgctccaaatccaggttgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgctgtgcctcggcctgattttggttgtcttcctcggcaaagaaacggtgcatctggctgatgtgctgttcgcgccagaacaaaccagcaaatatgagctggtagaaggactggtggtttactttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggctgcgatcctgttactggtgatcaccctgtggctgtgtaattcgaaacggctgaagcgggagtaaaaagtcagcacgccgaaatggcgcggcgtgctggacaggaagattacagcgtagcagtttgttgtgttttcttcgtttccggttcccagagcgcttccagctcctcaagggttttacctttggtttccgggacaaatttccacataaacagtgctgccagaacgcccatacaaccgtaaatccagtaggagaaaccgttgtggaaatgggccaccagccaggagtttttgtccatcatcgggaaggtccaggagacgaagtagttcgccagccactgggccgccaccgcgattgccagcgctttaccacgaatagcattcgggaagatttccgacagcagtacccagcataccggaccccaggacatggcaaaggcggcaacatagaacagcatcgacagtagcgccacaatacccggtgcctgagtgtaaaacgcggtaccgaggctaaacataccgattgccattccgagtgcgccgataatttgcagtggcttacgaccaaatttatccaccgtcataattgccagaacggtgaaggtgaggttgataactccgacaataatggtctgcaacagcgcgatatccgtgctggcccccagcgttttgaacacttccggcgcgtagtacagcaccacattgatgccgacaaattgctggaagatggagagcattacgccgattacaatcacgcccacgccaaacatcagcagacgaccaccggttttgcggccatgatccagggagtgtttaatttcctgtactgcctgagttgcaagcgtgttgcccataattttgcgcaggataccttccgcctgttcttgcttgccgcgcgacatcagccagcgaggactttctggcacggtatacagcagcattaagaacagcagtgcagggatacattccgaggcaaacatataacgccagccgtcagtattcagccagctggcatcaccggaacgggcaataaaatagtttacgcagtaaactaaaagttgcccgaaaataatcgcaaactggttaaaagagaccagtttcccgcgaatatgagctggagccagttccgcaatatacattggcgagagcattgaggctaaaccaacgccaataccgccaataatgcgataaataacaaattccgggacataacctgccagataaacaggcacagtgttgtccgggtttatagaggtaaaaccaagttctggccaggcagaacctacaccagaaataaaaaacaggacagcagcaatcttaagtgaatcacgacgaccgaagcggttactgcaataaccaccgagggcaccgccgatgatgcaaccaatcagagcgctggccacgcaaaaccctaacagggagttggcagcggattcacttaagttttgtggagcaacaaagacggtattgagtgactcaacagtaccggaaataacggcggtgtcgtagccaaataataaaccacctaatgtagcgactaaggtaatcgaaaatatataactggaattatactgggtattcattcagacctgccttagaccattctgatcttttatcagtgcattgatgttggaattgtcaggcagttaaggcaattatcattttttacaatgcgtttacgtaatgtcttttctgtgatcttaattgtgataattatccaaaattgataaaaacaatactattgccgtgactcagagcacgaaagagaattatcgtaagtgggaaaacaaataacgtaaaaataataagctctatgatggaaatattaaccggcgaacgattcagattgcagacgaaagaaaaaaaggcgctccgtggagcgccgaataacagtcacaagttgggataacgtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaacagcgacgcgaccggaacttcagtaatggcagcgataaacgacaggatgaataccaccgccagaatcggtactgacagcggcaacaggacaaggcggaaggcctgccacggtgtcgcaccatccagcgcagcagcttcttccagcgaactgtcgatggtttcgaaatagcctttgatggtccagacatgcagcgcaatcccacccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccggcgacctttaccgagttccacagccacagcagtaccgggaatggcggtggcgtaatgcgaccatcagcctgttcaacgctaaaacctaacgccagtttccagtgatcccaggagatttgctccgggatcaggctgccggtcgcaaagtttccctgacgcagcgagatagcgacgaccatcagcagcgggaacataatcgctgcgataaaaagtagcagtagcaggtgagtaataaataaacgagctttttgcgatttcggttggaccattgccatttttgttatctcccttaatcaaacttcattcgcgtggctttcaggttcactatcgccagcgcacccaccagcaggaagatcagcgtggcaattgctgccgccagaccgaagtcctgacccccgccgccttcaaaagcgatgcggtaggtgtagttaacaagcaggtcggtataaccggctggcgtggtcgtgccaagacgatccgggccgccgttggttaacagttgaatcagcacgaagttgttaaagttaaaggcgaagctggcgatcatcagcggcgtcagcggtttaatcagcagcggcagcgtaatcttaaagaagttctggaacggacctgcgccatccattgctgaggcttcatacaaatcgtccggaatcgctttcagcaagcccatgcagaggatcatcatgtacggataacccagccaggtattgacgataattagcatcgtgcgggcggtggtcggatcgctgaaccaggcgggcttcacgccaaacagcgcgctcaacatcatgttgatttcaccgaagctctggttaaacaaccctttgaaaatcaagattgaaatgaacgatggcaccgcgtagggcagaatcagcaggacgcgatagaccgctttgccgcgcaacgcttcccactgcaccagacacgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatcaccccagttgccgtcggcggtaatggactggtaaaagccaatttggttattcggacgatatttcacgccgctctgattattcgtcaacgtgccgtcaccgtcgagtgtgtagagcggctgcgtgccagaaaactggcgcagggagctcatcatcactttgttgccatccggcagaatggcggtaatgtcactcagcgcctgacgattctgggtaatcacgcgcagattcgcgcgttcgccttcgggctgggcggtcgtttctttcagttgcagtttttgctcgccgccaaatttaaaagcgtcggagaggtaatttttgccggtttcgccgtcgctgagcgccagttgccactcatcgcccgccgggtaaagaccaaagttataggttttgcctgcttgccaggagcgatctaacaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgaactcaatatcagcgtggtaatggcgaacaggtattccccttgtgcgtacattaaaacaacaaggtaacccaccagcaggccgagcagacctagcactgaccatttcagcgcgtcgctttgccaccaatgtttctttttaatgacatccatggggttcttcctcattccaggacggataaggctttcacgccttatccgacaacaactgcctgatgcgacgctgacgcgtcttatcaggcctacatacgtttcggttttgtaggccggacaaggcgttcacgccgcatccggcatttcacagcattacttggtgatacgagtctgcgcgtctttcagggcttcatcgacagtctgacgaccgctggcggcgttgatcaccgcagtacgcacggcataccagaaagcggacatctgcgggatgttcggcatgatttcacctttctgggcgttttccatggtggcggcaatacgtggatctttcgccaactcttcctcgtaagacttcagcgctacggcacccagcggtttgtctttattaaccgcttccagaccttcatcagtcagcagatagttttcgaggaactctttcgccagctctttgttcggactggcggcgttaatacctgcgctcagcacgccaacgaacggtttggatggttgacccttgaaggtcggcagtaccgttacaccataattcactttgctggtgtcgatgttggaccatgcccacgggccgttgatggtcatcgctgtttcgcctttattaaaggcagcttctgcgatggagtaatcggtgtctgcattcatgtgtttgtttttaatcaggtcaaccaggaaggtcagacccgctttcgcgccagcgttatccacgcccacgtctttaatgtcgtacttgccgttttcatacttgaacgcataacccccgtcagcagcaatcagcggccaggtgaagtacggttcttgcaggttgaacatcagcgcgctcttacctttcgctttcagttctttatccagcgccgggatctcttcccaggtttttggcgggttcggcagcagatctttgttataaatcagcgataacgcttcaacagcgatcgggtaagcaatcagcttgccgttgtaacgtacggcatcccaggtaaacggatacagcttgtcctggaacgctttgtccggggtgatttcagccaacaggccagattgagcgtagccaccaaagcggtcgtgtgcccagaagataatgtcagggccatcgccagttgccgcaacctgtgggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccaccgtcgctttgtgtgatctctgttacagaattggcggtaatgtggagatgcgcacataaaatcgccacgatttttgcaagcaacatcacgaaattccttacatgacctcggtttagttcacagaagccgtgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgccagcagaacgcggcgttggtatggtgtttcagtcttacgcgctctatccccacctgtcagtagcagaaaacatgtcatttggcctgaaactggctggcgcaaaaaaagaggtgattaaccaacgcgttaaccaggtggcggaagtgctacaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgccggtcgcgtggcgcaggttgggaaaccgctggagctgtaccactatccggcagaccgttttgtcgccggatttatcggttcgccaaagatgaacttcctgccggtaaaagtgaccgccaccgcaatcgatcaagtgcaggtggagctgccgatgccaaatcgtcagcaagtctggctgccagttgaaagccgtgatgtccaggttggagccaatatgtcgctgggtattcgcccggaacatctactgccgagtgatatcgctgacgtcatccttgagggtgaagttcaggtcgtcgagcaactcggcaacgaaactcaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcagg

SEQ ID NO: 17 - protein, 524 aa, Artificial Sequence
  Description of Artificial Sequence; note = synthetic construct
MLSTLRRTLFALLACASFIVHAAAPDEITTAWPVNVGPLNPHLYTPNQMFAQSMVYEPLVKYQADGSVIPWLAKSWTHSEDGKTWTFTLRDDVKFSNGEPFDAEAAAENFRAVLDNRQRHAWLELANQIVDVKALSKTELQITLKSAYYPFLQELALPRPFRFIAPSQFKNHETMNGIKAPIGTGPWILQESKLNQYDVFVRNENYWGEKPAIKKITFNVIPDPTTRAVAFETGDIDLLYGNEGLLPLDTFARFSQNPAYHTQLSQPIETVMLALNTAKAPTNELAVREALNYAVNKKSLIDNALYGTQQVADTLFAPSVPYANLGLKPSQYDPQKAKALLEKAGWTLPAGKDIREKNGQPLRIELSFIGTDALSKSMAEIIQADMRQIGADVSLIGEEESSIYARQRDGRFGMIFHRTWGAPYDPHAFLSSMRVPSHADFQAQQGLADKPLIDKEIGEVLATHDETQRQALYRDILTRLHDEAVYLPISYISMMVVSKPELGNIPYAPIATEIPFEQIKPVKP

SEQ ID NO: 18 - DNA, 10499 bp, Artificial Sequence
  Description of Artificial Sequence; note = synthetic construct
tcgcccctctggggagagggttagggtgaggggaaaaggcggcatcgaagccaatcagcccctatcaaccgcctttacgaatcaaataacgataaggcagtccatccgtctctttagcaaccagttcgtgttccataaaggtacaaaacccaggaatatcgcgggtagtggccggatcgtcggcgataatcagcaacgtttcgccaggctgcatattgcgcacggttttgcgcaccatcatcaccggttccgggcagcgcaggccaagcgcgtcgagtgtgtggtcagggctggaaaagagatcggtcattttcttctcatcacttaaaaaaacggcgctagtttacgccctgtgagtccgtaagcaaactaggttaacgattgcgtgaaaattaaccattgcattgtcaacgtaaagcagtatcatgcggcggctcgaaaaaagggtaagcacgttattatgttaaggtaacagacgtgtcgtacgtattgggttccctcaccccaatggttaatcaaaaaggtacaatatgaacgttttctcgcaaactcaacgctataaggcgttgttctggttatcgttatttcatctgctggtgatcacctccagtaactatctggttcagcttcccgtctccattttgggtttccataccacctggggcgcgtttagctttccgtttatttttcttgctaccgacctgaccgtgcgtatttttggcgcaccgctggcccgacgcattatcttcgcggtaatgatccctgcgttattaatctcctacgtcatctcgtcgctattctatatgggttcctggcagggattcggcgcactcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacagcgtccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagtattatctccgcgaaaggccagacggcgtactcttccgttattctgggtaacgtgggtaatcaactgctgaccatgcaaattacgctgcccgctgacgatcagcaaaaagcgcagaccaccgcagaaaacatcattaatacgctggttattcagtaagttttaagatgatgaggcggcctcagggacgtgttccggaggccgtttttttaatcgccacgtcagtaataacgcgattgcgaccagtcccgccgccgccagataaatcaccggtacgcccgcccagctcatcaccagcccagccagtggtccagtcacgccaagcgataaatccataaatacggtgtaagttgccagcgccgccccctgattttgctgcggaaccgcttttaccgccactacacccaatgccgggaacaccagcgaaaacccggcccccgccagtaagacgccgattttcgccatccacggcatagtcgccacgccaaccagtagcaggccgattatctcaacgctaaagcaaatcatcgctacgtttaagccaccgatacggttaatgccgttagggaataacaaacgcgtaccgacaaacgcacagctaaacagcgtcagcgcgaaagccgcaccgtcccaacctttagcgtcataaaacagcgtgataaaggtggcgatgacgccaaatccggcggaagccagtgccagcgccataccgtacagccagacgcgcccaagcaccgcgcgaaacggcagcggtttgcctttactggcttttaccgtcggacgcgggatcgccaacaaaatggccaccagcgccacgcccataatgattaacgctaacgcctgcaagccgccccagtgataaaacacgacgcctaacggcgcacccatcgccatcgccccgtaagtgacaatgccgttccacgaaatcacccgcccgatatgcagcgagccaaccacgccaacgccccatagggtcgatcccgttccggcaaaactttgcccaatcccaaggatgacgcgccccaggcaaagtaataacaggctgatgacaggcagactggcggttaatcctgccgtcagataccccagaccgctcaaaaagcagccgcataaaccgaagacgacaatctttttgggtcccagcgaatcggcgtaacgtccggcatgagggcggctcagcaaggtggcgaaatattgcaggctgataaccaatcctgcccagaaggcgctaaagcccatcacatcatggacatagcccggtaatacagcgagcggcaacccgatggtgaggtagctggcgaagttaaacatgactatagagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagctggcctcgctggtagtgatcctcgcgggcattcacgcagcggcagatatcattgtgcagctgttactggcgctgttttttgccatcgtcctcaacccgctcgtcacctggtttattcgtcggggagtacaacgccccgttgccattacgattgtagtggtggtgatgctgatcgcactaaccgcgctggtcggcgtactggcggcatcgtttaacgaatttatctctatgctgccgaagtttaataaggagctgacgcgcaaactttttaaattgcaggagatgttgccttttcttaatttgcatatgtcgccggagcgaatgctgcagcggatggactcggaaaaagtggttaccttcaccacagcgctaatgaccgggctttccggggcaatggcgagcgtgcttttgctggtgatgaccgtagtttttatgctgtttgaagtgcgccacgtcccttacaaaatgcgttttgcgctgaataatccacagattcacatcgcgggattacaccgcgcacttaaaggcgtttcgcactatcttgcattgaagacgctactcagtttatggacaggtgtcatcgtctggctggggctggagctgatgggggtgcagtttgcgctgatgtgggcagtactggcgtttttgctcaactacgtgcccaatatcggcgcggtaatttccgccgtaccgccaatgattcaggtgctgctgtttaatggtgtttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggtagcaaactggcgattttactggggccgggcagaccgaaaagtcggttaccgggatgaggcgacaagtgatacgatacgcactttcattttccattaaacgttggccctgatatgtatcggatagttctggggaaagtttcgaccttaagcgcagctccactgccaccgggtttacgcgagcaagcaccgcaaggtccacgacgcgaacgctggctggcggggcgtgcattgctttcgcacacgctttccccgctaccggagatcatctatggcgaacaaggcaaacctgcatttgcgccggaaatgccgctatggttcaacttaagccatagcggtgacgatatcgccctgctgttgagtgatgaaggcgaagtcggctgcgatatcgaagtgattcgcccgcgcgccaactggcgctggctggcgaacgccgtattcagcctcggggaacacgctgagatggacgccgtgcatcctgatcagcaactggaaatgttctggcgcatctggacgcgcaaagaagccatcgttaaacagcgtggcggcagcgcctggcaaatcgtcagcgtagacagcacctatcactcctcgctgtcagtcagccattgtcagcttgaaaatttaagccttgcgatctgcacccctactccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgctctccacactccgccgcactctatttgcgctgctggcttgtgcgtcttttatcgtccatgccgctgcaccagatgaaatcaccaccgcctggccggtgaatgtcgggccactaaacccgcacctttacacgcctaaccagatgttcgcccagagcatggtttatgaaccattggtgaaatatcaggcagacggttcggtgatcccgtggctggcaaaaagctggactcattcagaagatggtaaaacctggaccttcaccctgcgtgatgacgtgaaattctccaacggtgaaccgttcgatgccgaggcggcggcagaaaacttccgcgcagtgctcgataaccgtcaacgtcacgcctggctggagctggcaaaccagattgttgatgttaaagcactcagtaaaacagagctgcaaattaccctgaaaagcgcctactatcctttcctgcaagaactggccctgccccgtcctttccgttttatcgctccctcgcagtttaaaaaccatgaaaccatgaacggaattaaagcgccgattggcaccggaccgtggattttgcaggaatcgaaactgaatcagtacgatgtcttcgtccgtaacgaaaactactggggcgaaaagccagcgattaaaaagatcacctttaacgtcatcccggacccgactacccgcgcggtggcgtttgaaactggcgatatcgacctgctgtacggaaacgaagggttattaccgctcgataccttcgcccgctttagccagaatccggcttaccacacccaactgtcacagccgatcgaaaccgtgatgctggcgctcaataccgccaaagcccccaccaacgagctggcagtacgtgaagctcttaattacgcggtaaacaaaaaatcgctgattgataacgcgttgtatggcacccagcaggtcgccgacaccctgtttgccccttctgtgccctacgccaacctcggcctgaaaccgagccagtacgatccgcaaaaagcgaaagcgttgctggaaaaagccggttggacgctgcctgcgggcaaagacatccgcgagaaaaatggtcagccgctgcgcattgaactttcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatatgatccacacgccttcctcagttcaatgcgcgtaccgtcacacgctgacttccaggcacagcaaggattagccgacaaaccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtatcaaaaccggagctgggtaacatcccctacgcgccgatcgccaccgaaattccgttcgaacagattaaaccggtgaaaccttaatgttgcgttacgtattacgccgctttctgctgctgatcccgatggtgctcgccgcctcggtgatcatttttctgatgctgcgcctcggtaccggcgacccggcgctcgattatttgcgtctgtctaacctgccgccgacgccggagatgctggcctctacccgcaccatgctgggactggatcagccgctgtacgtccagtacggcacctggttgtggaaggcgctgcatcttgactttggtatctcattcgccagccaacgcccggtactggacgatatgctgaacttcctgcccgccacgctggaacttgcaggtgcggcgctggtattaattctgctcacttccgtaccgctcggtatctgggcggcgcgccatcgcgaccgtctgccggatttcgccgtacgtttcatcgcgtttcttggcgtgtcgatgcctaacttctggctggcgtttttactggtgatggcgttttcggtgtatctgcaatggctacccgcgatgggttacggcggctggcagcacatcattttgcctgcggtttccattgcctttatgtcgctggcgattaacgcgcgtttactgcgcgccagtatgctggacgtcgccggtcagcgtcacgtcacctgggcgcgtctgcgcggcctgaacgacaaacagaccgaacgtcgccacatcctgcgcaatgcctcgctgccgatgatcaccgccgtggggatgcatatcggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgcattcgtcgtcatgaaggagcgcacgcgtgaactttttcctctcttcccgctggtcggtacgcctggcgctgatcattatcgccctgctggcgctgattgcgctcaccagccagtggtggctgccgtatgacccacaggcgattgatttgccgtcgcgcctgctttcgccggatgcgcagcactggctgggcaccgatcacttaggtcgcgatattttctcgcggctgatggcagcgacccgcgtgtcgctcggttcggtaatggcctgcctgctgctggtgctgacattagggctggttattggcggcagcgccgggttgattggcgggcgcgttgatcaggccaccatgcgcgtcgccgatatgtttatgaccttcccgacctcgattctgtcgttctttatggttggcgtgctcggcaccgggctgaccaacgtaattatcgccatcgccctgtcgcactgggcgtggtatgcacgcatggtgcgcagcctggtgatttcactacgccaacgcgagtttgtgctggcgtcacggctttccggtgcgggccatgtgcgggtgtttgtcgatcatctggcaggcgcggtgatcccttcgctgctggtgctggcaacgctggatatcggccatatgatgctgcacgtcgcggggatgtctttccttggcctcggtgtgaccgcgccgaccgccgaatggggcgtgatgattaacgacgcgcgccagtatatctggacccagccgctgcaaatgttctggccggggctggcgctgtttatcagcgtgatggcctttaacctggtgggtgacgcactgcgcgatcatctggaccctcatctggtgacggagcacgcacactaatgccgcaacagattgaactacgtaatatcgcgctacaggccgcgcagccgctggtacacggtgtatcgttaaccctgcaacgcgggcgcgtgctggcgttagtcggcggtagcggcagcgggaaatcattaacctgcgccgcaacgctgggcattttgcccgctggcgttcgccagacggcgggggaaattttagccgatggcaaaccggtttcgccttgcgccctgcgcggcatcaaaattgccaccatcatgcagaacccgcgcagcgcctttaatccactgcacaccatgcacacccacgcgcgggaaacctgcctggcgttagggaaacccgccgatgacgctacgcttaccgctgccatagaagcggtggggctggaaaacgccgcgcgcgtgctgaagctgtacccgttcgagatgagcggcggcatgttgcagcgcatgatgattgcgatggcggtgctgtgtgaatcaccgtttatcatcgccgatgaaccgaccaccgaccttgacgtggtagcacaggcgcgcatcctcgatctgctggaaagcattatgcaaaaacaagcgccgggaatgctgctggtgacccatgatatgggcgttgtggcgcgtctggcggatgacgtggcggtgatgtctgacggtaagattgtcgaacagggcgatgtagaaacgctgtttaacgcccccaaacatacagtgacgcgcagcctggtttccgctcatctcgccctctacggtatggagctggcatcatgactttacttaacatctccggcctttcccatcactatgcgcacggtggatttaacggaaaacatcaacatcaggcggtgctgaataacgtttccctgaccctgaaaagcggcgaaaccgtcgccctgctggggcgcagcggctgcgggaaaagtaccctcgcgcggttgctggtgggtttagaatcgcccgcgcaggggaatattagctggcgtggcgaaccgctggcgaaactcaatcgcgcccagcgtaaagcgttccgccgcgatattcagatggtatttcaggactccatcagcgccgtgaatccgcgcaaaaccgtgcgcgagatcctgcgtgaaccgatgcgccacctgctatcactgaaaaaatccgaacaactggcgcgcgccagcgaaatgctgaaggcggtcgatctcgatgacagcgttctcgacaaacgcccaccgcagttaagcggcggccagctccagcgcgtctgcctggctcgcgcgctggcggtcgaaccgaaactactgattctggatgaagccgtttctaaccttgatctcgtgttacaggcgggtgtcattcgcctgctgaaaaagctacaacaacagtttggcaccgcctgcctgttcatcacccacgacttacgcctggtagaacgcttttgccagcgggtaatggttatggacaacggacaaatcgtcgaaacccaggtggtgggagagaaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacgctggacagcctgagccagcgtcgtggttataacaaccgttccgaagctatccgcgacattctgcgtagcgccctggcgcaagaggccacccagcagcacggcacgcaaggtttcgcggtgctgtcgtatgtgtatgaacacgaaaaacgcgacttagccagccgcattgtctccacccagcatcatcaccacgacctctccgtcgccacgctgcatgtgcacatcaaccacgacgactgtctggaaatcgccgtgttgaaaggtgacatgggtgacgtgcagcattttgccgatgacgttatcgcccagcgcggcgtgcggcacgggcatttgcagtgcttgccgaaggaagattgagtctattattgggtcctttggtgaacgatcaacaaagggccactagcacacctgattcctctctaaataccctatccgaaccttctcttttgtaacgttctaaatatattcctaaaaatcttcaattcattgtgaccacaagtttttcttcgctttttcgtatgaagatactgtcattaaaataatagaaaaggat

SEQ ID NO: 19 - protein, 338 aa, Artificial Sequence
  Description of Artificial Sequence; note = synthetic construct
MNAKIIASLAFTSMFSLSTLLSPAHAEEQEKALNFGIISTESQQNLKPQWTPFLQDMEKKLGVKVNAFFAPDYAGIIQGMRFNKVDIAWYGNLSAMEAVDRANGQVFAQTVAADGSPGYWSVLIVNKDSPINNLNDLLAKRKDLTFGNGDPNSTSGFLVPGYYVFAKNNISASDFKRTVNAGHETNALAVANKQVDVATNNTENLDKLKTSAPEKLKELKVIWKSPLIPGDPIVWRKNLSETTKDKIYDFFMNYGKTPEEKAVLERLGWAPFRASSDLQLVPIRQLALFKEMQGVKSNKGLNEQDKLAKTTEIQAQLDDLDRLNNALSAMSSVSKAVQ

SEQ ID NO: 20 - DNA, 20906 bp, Artificial Sequence
  Description of Artificial Sequence; note = synthetic construct
ccaggctgtttttttgagttgcatcgccatgcgagagagaactgttggcatattaaatacatcctgtctgctgcgaacaatatctgtagtgaatatcaatatccattgaaggcgtcagtatggctattttcttgatgaataaaaatagctttattcagccaccgcattcataacttatatattttatttattaattggctgtatatatttttaaaataaatacttttgggggcttcagcgcccccaaaagcgagtgacattaatttggggttacgatattcacccacaaatcgaaattatccagacaggcgataatttcttccagtttcgcgccattgccaataattttggctttcttcgcttttaccagatccgccattttggcttgtccggtcagcacggcgtgcagatcttcacggctgatgtagaaagaggcgtcggcttgcggttgcagcgttttccggtagttaagcacgctatcgttcagcgtcaggttgaggttatcgccgttgctcatattgaagttcaggctgatatttttacccgcagctttcgcgctatcgaggcgaacggccataaagtcgaacagcatttcgaccgacatcccgcgaatggtgtccggggaaccggtggtgccgtggctgaacttatgcaccccttcgcgcagctctttcgcgccggtcaggtagaaaccgcgccatgtggcggactcggcctgatagcccagctgttcaaagttattcgcttgcagattcttcgcgacctggtcacccgggttggcggcaatcacctgtttcagcagttctgccgaccagcggtaatcaccttgcttgttcgcttcttgcgccaggttgatgacacgggcagaaccgcccagcgcctgcacgtaacgtttacccatctccacctgaccatacggatgcaggttagccgggttaccgtcgtaatagccaagatagaagttatacaccgcgcgggcgttgtggctgacagaaccgtaatagccgcggctggcccagttattggcaagtgcaggcggcagcttaatcatgtcgccgatttcattcatggtgtagccctggttcgccaggtgcagggtctggtcgtgaatgtacttgatggtatcgcggtatttaccaatataatcattgatatgcttattgccccagaccggccaggtgtgcggcataaacagcacttccgcgtcgttaccccacatatccagcgtttcgttcagatactcggtccacttgctggtgtcgcgggttttcgcgccgcgcagagtgtagaagttgtgcagggtatgcgtggcgttctcggcggtacacagggctttcagggccggaatatagaagtgcatttcggctggcgcttcgctacctggggtcatcaggaagtcaaactccaggccgtcgataatcatcttctcgccagttctgacgatagttttcgtcggtgcaataatgctcgggtcgcccgttgccagcgtcacgccaaggccattacccacattgccttgcgcgttgtgcggcagtaacagaccgtaagagtagagcgcacggcggctcatgatgttacccgccagcacgttttcgctgatggcttcgtccataaagcctgcaggggcaatcacctgaactttgccggatttaacatcggcttcagagataatgcctttcacgccaccatagtggtcggtgtggctgtgagtgtagataacggcaacaatcggtttttgcggacgatgctggaagtaaaggtcaagtgcggcttttgcggcaggcggcgtcaccagcgggtcgataacaataatgcctttctcgccctcaacgaacgtaatgttagagatatcctggccgcgcacctgatacattttatcggtgactttgaacaggccagaaataccgttgatttgcgactgacgccacaggctggggtttacggtttccggcgctgcggcattaatatcaaatttgtaatcgtccgcgcggtagtaaactttaccgttcgcatcacgcagaataccttcatccagcagcggggcgataaatccacgctgggcatcgtcaaaatcctgacgatcgctaaacggtaatgatttggcgtaattctgattaacctgttgggtatattgagtggcggctttcgcttcctctttcgcgttagcggtatttaccatcatgccgctggcggcagttaacgcaataacaatcctgctcaaacggaataaccgagagttattcatataaatctccatttatcatttatgtcgtaaatatgtaatccatgcaaaatacgtcatttaaagctggcgttatcataattgggaaattgcgactttaataagtggaagtgtgagcggaacgcgccattttattaggcatttgtgctgaagagggaaaattacagtaaaactatcattgcagaaaataatatgagtcgttttatgtgtttattatatatattgtacctgtcgttggcacagcgggacattgcgctactgtgccaacgttttactcatggggctttagcacagaactgtggcaaaaaacgttgatgcgccaatattgctgcaccctgagcgccattaaagtcagaagatgaggcggcaataaagcgcacgacctgatgcggcagtggacggcgcaggtacttttgggtcatggcaacgagagtctcgcgtgggaaggcgggcatatccatcacgccaccgcccaggatcaccgcatcgggatcgaacagattaatgctggtggcaatggcccgtgccgcgttttcaagcagactctggacgaaaggggcgttttccgcatggacgaaaagatcgcgcaatgggtaatttcggggctgttgttcgtaccagcgtcttagcgccattccagagcaattggtttccaggcacccaggattgccacacgcgcagtgttgggtcatatctcccagggggatatgacccagttcgcctgccacaccgtgtgcacccgtccacggcgcaccgttcatccacactgcgaaccccatccccgtaccgagataggccgccagaaccagttgttgcgtaaggcggttttctactacgtcccaggagagttgcaggttaacgtcgcgggaaaactcaaccggacaattcagcgtattttcgagcttatcggcgagatcatataaatccgccgctgttaacggcaggttaggcgtagaaataatggtgcgtttatctttactgaccagcgccggaaatcccatcaccagaccatgacagcgagcgttaaagcgcctgagttgctcgtcaatcatttcgccgatacccgacaccaggccgggagcaatgacttctgcggtccgctttttttcgcagtgtagcgtttcaccttctgctgtccgcagacaaaagcggatatgcgttgcccccatatccacgcccgctacgacgttatgctgtttttgcatgaggctgtacctcgctttttgcagccagaatctgcgcggtcataattctccatgcttcgtcgatattttccgcatgattaaacaggccggaagtgccgacgataaagacatccgcccctgccgccatcagtttttcgtaagttgcctggttgcaggaaccgtccacctcaatttcgtactccagaccttctcgttcacgccatgccttcagttcggcaagtttatccagcatttcaggaatgaacggttgtccggcaaagccgggatcgacagtcatgaccgtaattttatcggccttatggatatagtatttcatggcctcaactggcgtctccgggttaaggatcagccccactttcatgtcatgacggcggatttcatcaatcaggcggaacgcctggccgttgatggtttccggatgcagagtgatgaaatctgctcccgcacgcgccagttgagcaatgtaatcctgcggccgcgtcaccatcagatgacagtcgagcggtttagttgccagttttttaacctgacttacgaagaacggtgagagtgtcagattggggacaaagtgaccgtccatgatatcgatgtggaagtaatcggcatggctgtcgataaattcgatctgttctttaaatttcagcagatccatacacattaacgagggggagattttcatgttcaattccttacttactgataagacggtcaagggcgacagccgcgataattaatccgcccatcaccaccagttggtaataggtttgtacctgcaaaatattcagaccgttgttgatggtgccgatgatcaacccgccaatcaccacagagaaaatgcgccccttgccgccgaagaaactggtgccgccaatgatggcgctggcaatggcataggtttcaaaacccataccggcaagcggttctgcggcaccgagtcgtgcagttgagacgacgcctgccagacctgcacaaacaccggagatgataaacaccaccaggatgtggaatttcacgtcaatcccggaatagaacgccgaatttttgttgccgcccagtgcgtagatgttgcgcccgagccgcatacgcgttgtcagaaaccaaaggatgagcgcgacaattagtgagaagataacggggacaggtatcccaattacgctggcggcaaagaagttcacgaagtcaaatgagaagccgtataccgagttggcatcggagatcaccagcgtgatcccacggaaaatcgcgttggtgccaagggtgatgatgaacgggtgtagccccgtccagttgaccaggcagccgttgatcgcccccagtgcgccgccaaccagtacaccgccaatcatcgctgcgagaaacgggtcaacacctgccaacatcagtttggcggtcaccataccggaaagcgccagaatcgcgccaaccgagaggtcgataccagcgaccaggatagcgaaaaactcgcccatgccgatcaataccgtcacggagctttgaacaaaaatctgggtaatattattggtggtcagaaaatattctggtgacagcgaaccaaagatggcgacgatgatcgccaggataaaaaaggtgccgtatttatcccagaacagcgcaaagttgaacggtttcttctcgctcgcttcgctttttactcttgtggtaaagcccatgccataatctcctcttcgctcatgtcatcgcgattcgtcaggatttgcgtcagtcgtccttcgcagaacacggcgatgcggtcgcagacggtgataatttcaggtagttcagatgacaccatcaggatgacttttccgtcgtccgccagttggcgcatcactttgtaaatttcggctttcgcgccaacgtcgatgccgcgggtaggttcatcgaaaataatcacttccgggcaacagcacagccatttggagatcaggactttctgctgatttcccccggagagttcggtgatattctggtttaccgaatgacatttcagcgccagcagttcgcgttgattttcagcggtacgttgctcgtcaacttcatgaaacaagcccatcgcgcctttatagccgccgtctttcagactgcggctgatcgccatgttctgagcgatggaaaagttggggaaaaaaccgttatcccggcggctttcagtgatgtaagccatcccttttttcacggcatccaggggtgaacgtggagagatatctttgccattaagacggatttctccgccagcgcgtttatccacgccaaacagacaattcatcagttcagtacgtccggaaccgaccagtccggcaaagcctaatatttctccccggcagacgctaaatgagatatcccggaccttttttctgtcacgactggtgacgttccgcacctcaaaaaccgtttcgtgcgcaaggttgctgacattctccttcatcgcgttaaaacggttttgcagttcgcggcctaccatcagacggacgatatcgtcatttgacacatcgcttactatgccgctgcaaacgctgctgccgtctttcatcaccgtatagcggtcgcaaatacggcgaatttccgccaacttatgcgagatatagacgatggccgtaccctctttacgcaactgattcatgatcagaaacagatagtccacctctttattggtgagtgaggaggtgggttcatccatgatgatgactttggcatcgagcatcagcgttttggcaatttctagcatctgcttgtggctgatagataaattcgccactttctcatctagatcaactttcaagcccacgcgtaataacatcatggcggcgcggacacgcatttctcgccagtcgataatattgacgccacagatttttttcgtcagatgacgaccaatatataaattttccagtacggttaattcatcaataacgctgagttcctgataaataatcccgataccgagttgtgccgctaatttatgatccagcttgttatagctaatgttattaatggtaatggtgcctttggtcggctcatgtattccggataaaactttcattagcgtggatttacccgcgccattttctcctagtaatgcatgtatttcaccaggataaaccgttaaattaaccgactttaatgcgtgaaccggaccaaaggacttgccgatccccgccatcgatatatatggcgtggccataaataacctctctgcacgaaatatcgtattattgcctgatggctacatttatcaggtctacgttcaggttattttgttggccggataagacacttcattagcatcatcatccggcatcattcagttttattgagtgaccaggattgaatcgaccagtttaaattccggtgctttatccagcgggataaccttgccggatttctcagcgtcaaccatcagcttcagacccgttgcgccgatatccgccgggttctgggcaaccgtcgcggtcatttgtccggcttccaccattttgcgggcttccggaatgccatctgtaccgacgaccagcacttttcccgtttttccggcgtttgcgactgcctgagcaacacccattgccatcgtgtcattcgcgcaatagatcgctttaatattcggattacgttgcaacacgttagtggcgacatccagtgctttaatgcggtcccagtcggcaggctggctggcgacaagcttgatctggcttgcttttttgaaggcttcggtggcaccattacgacgcgcttcaccggaggcgttaccggctttaccctcaatgattgcgacttcaccaccttcagcgcccaatttgtcaataatgaacgacgcgcctttcgccccgacagcaacgttatcggtggtgacaaaagcttccacattgccgccagcttttttcagattatccatgtcgattttttcatcgagattaaccagataaatgccttttttccatgcgcgggcgacaggcatgaccagattcactgaggataatggagcgaaggcgatacctttgtaatttttattactgagatcttcaaataactgcaattgagattgaaaatcgccttctgaaggagaggcaaaaatatcaacgctgacgcccagtgtttttgcttcatcttcaatgccttttttcatatctacccaaaatgggttggagagggttttcaatacgacagcatattcggcggcagcaaaagcgctggttgacaacattaagcccacgagtgtgccgctgaaatatttcagatatttattcataataatgttctcacggtaaggggacaggtaactccgcgatggcggaattacctttttcttatttcagcgcgcctggtgagaagaaatcaacaattgcgccggttttttgcatattaatattagcttgttcaatgttgagctgggcgacagagacaaaaaaagcgtccagcaaagttagttgtaatattcttgccgaggcattacgacctaataacggcgtttccggggctggtgagcaaataatataatcggccagtttcgctatcggtgaatggtagctatgggttatacaaataatctttgccccgttcttttttgccagttctacggccgcttttacatcactggttcgcccggaatgggtcactaccagcacaacatctccttcctgtaacaacgaagcggacatcatcatgatgtgagcatcaggataggcctgacagcgtacgccaatgcgcaagaacttgtgctgtacatcagcacagatagcatttgatcctccggcaccgtacaaatcccgctgtctggcctgatagaaaaagcgggcggcacggtggatctcatcaacgttgacgatcgactgaccttccataatggtgcgtaaagtgatgttaaataccttattcaccacatcctgcggcgcttcatcaaaagccaactcggaaggcaatacctgttctgactgagaaaaataatcttccagcgcactgcgtaagttacgaaagccgctaaaccccagcagctttgataccttaactatcatcgcttcagataccgccagagcttctgcgacatctttaattgcgggtgcacaactcaggttaccgggtttgagtaaccactccacgatgcggctttcattttctgtcattccttcctgcttcattcgcaggtaaggcgctaaccctataccgttcggaagcgctgaatcaaactctgactggctcatcacgttctcttgtccttgaattgaagacgccactatatcaccacagcaagaacagaaaagatgctggcgacttcacaaaaaaataaaatttataaagtttattttattgtgaacaatggcgagtggcttaaaattttatttcatttaattagtttaaaaacatgatgttatttgtttttctggttttttagatgatagatgttgctggatggtgagtgtctttaacgctattgcgctgtcagatgtaactctgtaaaacagatcaggaaggcgtaattcatcgattttgggtgtttttaattcattaacatcacaaatgttttttgattgtgaagttttgcacggacggggaagatgaatgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattgagattcatccactacttgcatggatgagtaatgattaatgtggatagagtttctttttgaggttggctaatgaaacgctttccgctatttcttttattcaccctgctcacgctgtccacgttccggcccaggccgatattatcgacgacaccattggcaatattcagcaggcgattaatgacgcttataaccctgaccgtgggcgagactatgaagattcgcgcgacgacggctggcagcgtgaagtgagcgacgatcggcgcagacaatatgacgaccgccgccgccagtttgaagatcgccgcaggcagctggacgatcgccagcgccagcttgatcaggagcgtcggcaactggaggatgaagagcggagaatggaagatgagtatgggcgatgaggttgggtatggagcaggcatcgcccctcaccccaatggggagagggagaaaacgagcgcaatattcaatatcgagcacaatcggtcccctcgcccctctggggagagggttagggtgagggggccagcgcgcacattccctctcatcacgccaccccaatctccatcccatcaaaccccacctcaaaccctgacggtagtgcgttttccatcagccacgcatcaaactggtggctgatatgggtcagaatcacccgtggcgagcggataacctgattcagcgcaagcacggtatttaaatcacagtgattacgcggtgcatccgcgcgcggcgggtgactgcaatccatcaccattacctgcggctgattattgcgtaaaaatttcagcgttttttccggcaagcctgcggtgtcagacagccacgccacccggctgtgtgccgtttccagcagataaccgaaggtcagttttgagtggttgagcggcaggggcgtgacctgtaacccctgcaaatcaaacaccacaaacggttccaccgtgtggctgaaatcaagcaggcccggatgtttaaacagatcgtcgcagccctgttcatccggcgggccgtaaaccgggatcggatcgccaacgccccagcgcagcggaaacagcccctggacgtgatccatatgataatgcgtcagcaaaaactgctggaacgatccgggcgaccagcgatcggcgagatcgtgcagcccggcgtcgatcagggtgattgcgtcgttaaacttcactacgccgctgcacggttggcggcgatactgcggcgagcgccgcgctctggcgcaggccgcacactcgcagccccatgccggaacgccctgtgcgccgccggtgccggtgagcgtgagggtcaggctcatgttacagcgccttggtgaagcggaagtggctctgctcgtagccttcgcgcagatagaaacggtgcgcgtcgtggcgcttcacgttggtcgaaagttcggtcatttcggccccggcctggcgggcttcttcttctgcccacgccagtaacttactgccgacgttcagaccgcgcgcctgcggcattaccaccaactcctgaatttcgccgatccagttgacatgatgcagatgaaactgcaaatgcaggccgatcatgccgacaacttcgccatcaagcagcgccagatggtagcgcatgtttgggtcgcgcagattggcgttaaaacccacgcgaaacgcgtggtggtcaaactccgcctgttttagctcacaaatcagcgcgtaaaccgcgtcggtgtcgtactgcgtggccgggcgaagctcacaagcaggcatggtgtttctccttctgatggatcagcgtcagcagcgtgtcgaccgactggcgcaggctgccgtcattgttgagcgtatggcaatcctgtggagtatagcgggcggcgcgcgccaggcgggcgttaatttcactggcgttttcacggccacggttttccaggcgctggcggaggatctccggcgaaacctgtaaacagacgggcagcagcgccgattgatagcgcgcccgcgcctgcggcagatgggcgcgtgagccgttgaccagcacgtcgaatccggcgtgcagccagagatcaatctcgacgccgacgccataatacagaccgttagcgtgccagcttaaggccaacagattttgccccgcgcgggtaaaaaactcctgctcgctcagggcgatatggttttcacttccggcgctggcatcgcgcgtgatgtagcgatgcgccaccagtaactgagtttgttcccgcaggcggagttccgccagcaggctgtctttcccggagccggacggccccattaaccaaatcagttttcccatcatcagaacacccttttaccctgacgccagacgtggtcgatatgaatatgattgtccttgcgatgcgccagcaccaggtcggcgcgtttgccctcgccaatcaccccgcgatcctggagattaagcgcctgcgctggatttttagtcaccagcttcaccgcctgcggcagcgtaaagcggttgctctggtcatcggcgacgcgaaatgccgcatcgagcaggctggcggggtagtagtcggaagagaggatatccagcaggccaagctgcgccagttcactggccgccacgttgccggagtgcgagccgccgcgcacaatattcggcgcgcccatcagcacgttcatgccatgcttgcgcgaggcttccgccgcttcgaacgtggtgggaaattcggcgatcacgctgccaagctggtgagattcagcaacgtgggcgtgggtggcgtcatcgtggctggcaagcgcaatttttcgcgcgcggcacagggcggcgatggattcgcgattcggctgcgaccagcgtgcggcgagcgccagttgctcttcttcgtactgctgcatctgcgcatcagtgagggagtatttgccctgataatattcgcgatacttctcgcggttggcgaactggcgctggcccggcgagtggtccatcagcgacaccagcgtcaccggctcgcgctgcaccagtttttcaaacagcggcagcgtggtgtgatgcggcagttcgcagcgcagatgcagacggtgctcggcgcggttgacgccgcgtttctgcgtctcttcgatggcgttgatcatcttctccagattctccagccgatcgccgccgtcgcgcacgtcgccaattgccacggcatccagtacggtggtgatgccgctcgccaccatcagcgcgtcgtggctgctcatcgccgagtgggcaggccagtcaactttcgggcgcggggtgaagaatttatccagattatcggtatgcagctcaatcagccccggcagcagccagccgccttcgccgtccatcgcctccggcaggcggctctggctttcggcaaaggcgcggatttcgccgttctgcacctccagcgaaccgcttaccacctcgttttccagcaccagcttaacgttattgataatcatgaagaggctcccattgggtgcaggcggtcggcgacgtcattacgtacagcttcgtcatggaagatgcctacgatggctgcgccacgggttttggcttcgcgaatcagttccaccaccgcggcgctgtttttggcgtccagcgaggcggtaggttcgtcaagcagcagaatggggtagtcgacgataaagccgcgggcgatgttgacgcgctgctgttcgccaccggaaaatgtcgatggtgccaggtgccacaggcgttccggcacgttcaggcgggtgagaagacgcgcggctttagcggcgcaggcttcacgcggaacgccggtatcgagcagcggctgcatcaccacttccagtgctgagatacgcgggatgacgcgcagaaactggctcacccagccgacggtggttttgcggatttccaccactttgcgcgctggcgcggtgaccaggtctacccactcgtcaccgtgtttgatctggatttgaccttcgtcgggcagatagttggcgtacagcgagcgtagcagagttgatttgccgctgccggaatggccgtggagcaccacgcattcgcccgcgttgacggtgagcgaggcgcgattgaggacgggcaggcgcacgccgttttgctggtgcaggatgaaggttttactgacgttttgtacgttaatcatttttcgcctcgtggttcgggtgtcggatgcgacgctgacgcgtcttatccgacctacggggagcgcatttgtaggccggataaggcgtttacgccgcatccggcaccggctcaattctgcaaaaccgatgacaccagcagctgtgtatacggatgatgcgggtcgtcgagcacgcggtcggttaacccactctccaccacttgcccctgcttcatcaccagcaaacggtccgccagcaggcgggcgacgcctaaatcatgggtgacaatcaccaccgcgaggttcagctccaccaccaggccgcgcagcaggtcgagcaggcgggcctgcaccgacacatccagcccgccggtcggttcatccataaacaccagcttcggatgcgtcaccaggttgcgggcaatctgcaaacgctgctgcataccgccggaaaaggtggtcggcaggtcgtcgatccggttggcgggaatctccacctcttccagccacttctgcgcggtggcacgaatatcgccgtaatgacgtgccccggtcgccatcagccgctcgccgatattgccgcctgccgacacctggcggcgcaggccgtcgagtggatgctgatgcaccacgccccattcggtacgcagcaggcgacggcggtcggcctcgctcattgcatacagcgaacggttctcgtagtgaatttccccctgctgcggcgtcaggcgcgcggagatcgacttcagctgcgtggtcttcccggagccggattccccgacaatgcccagcacttcccccggccataaatcaaaagagacatcgctaaagcctttgcccggcgcgtaaaggtgggtcaggttattgaccgaaagtaacggttgattcattggttttttgcctcgctctgttggcggcaataatcggtatcggagcagacaaacatgcggtttccggcgtcatccagcaccacttcatcaagatagctgtgggtcgatccgcagatggcgcatggctcatcccactgctgaacggtgaacgggtgatcgtcgaaatcgagactttccacgcgggtaaacggcggcaccgcatagatgcgcttctcgcgccccgcgccgaacagttgcagggcgggcatcatgtccatttttgggttatcgaatttcgggatcggcgacgggtccatcacgtagcgcccatttaccttcaccggataggcgtaggtggtggcgatatgaccgaagcgggcgatatcttcatacagtttcacctgcatcacgccgtactcttccagcgcgtgcatggtgcgggtttccgtttcgcgcggctcgataaagcgcagcggctcggggattggcacctggaagataattatctgatcttcggtcagcggcgtttcggggatgcggtgacgcgtctggataaccgtcgcatcgtccgtacgttccgtggtgtttaccccggtcacgcgcttgaagaagttgcgaatcgacacggcgttggtggtgtcatccgcgccctggtcaatcaccttcagcacgtcgctttcgccaatcacgctggcggtaagctgaatgccgccggttccccagccgtacggcatcggcatctcgcgcccgccaaacggcacctgataaccggggatcgccaccgcttttaagatggcgcggcggatcatgcgtttggtctgctcgtcgaggtaggcaaagttgtagccgctcagattagccatggttctgctcctgttgcagacgtttgagtagctccagttcggcctggaaatcgacgtagtgggggagtttgaggtgtgagacaaagcctgcggcttcgacgttgtcggcatgtgccagcacgaactcttcatcctgcgccgggcctgtcgcgtgctcgccgtactccggggcttgcagagcgcggtcgaccagcgccatcgccatcgctttgcgctcgctcatgccgaacaccagcccgtagccgcgcgtgaagtgcggcggctcacccggcgggtcgataaaaccgttaaccatttcacactcagtcatcagcagttcgccgacgttcaccgcaaatcccagctcttccggcacaatcgacacgtcgatatagccgctgcggatctcgcctgcgaacgggtgattgcgcccgtaaccgcgttgggtggagtaggccagcgccagcaaatagccttcgtcgccgcgcatcaactgctgcaaacgggaggagcgtgagcaggggtaaaccggcggcgtgcgggtgatgtcatccggctgtgcgccgctatcctcttcaaacttcgccagcccctgacgcgccagcaggctgaaaacgtgcggcgacggctgctgttcgctgtcggcggtggtcagcgtcggcgcttcgccgtttgccagcagggtaaaatcgagcaggcgatgggtgtagtcgtaggttgggccaagcagctggccgccgggaatgtctttataaacggcggagatacggcgttcgagacgcatcccggtggtgtcgagcggctcgcttaccgccagcttcgccaacgtggtgcggtaggcgcgcagcaggaaaatcgcttcaacgttatcgccgctggcctgtttcagcgccagcgccgccagttcgcggtcggcaatgccgccttcggtcatcacgcgatctaccgcgaggttaagctgctgttcaatctgggcgacgctcagttcgggcaaatcggtatcgcctcggcgtcggctctcttgcagggcgtgggcggcgtcgatcgccttctcgccccctttcacggcaacgtacatcagcacacctccacatgagtggttcgcggaatagccagcaggcgctcgccacaggtcaggatcaggtcgatgccgagcgggaacggatgcgggcgctcggtgagttcgtgcagaatgcactccggcagctgcggagcgatcattcgttcttcggcaatacccgcaccagtaaggcgcaacatgcgtccgccgctcaggctggcgacctgtaaaatcagcgtcgcacccgcttccggcgcaacggcggtgccggtggaaagggcgttgagctgttcgctggaaatcgcctcatccgtcaccgcgaaggtcgcctgttccggctggctgaccagcggcgcgttggtatgaaaacgcaggctctggttgacgatatcgttatttaatggggtagaaagccacaccggcgtgtcgttatcggccagcgtcagcagcacgctggtggtggcgatattcagcggttgccagccgcgtttgagctgatgcagggcgacaatcacgcccggctcgctcatggcctttaacaggcgacgaaaactgtgctgggcatcctgcacgggaagcataaaagcggtttccagggtcatgcgttgtctccgcgaaccatcgtaaagaagtcgacccggctggcgttcacttcggcctggcgtgcggcaatgcgtgccatacggtcagcgtccagcggggcaataagggtttctgataagttttgaaagtggcgagattgctgcatcagcgcgtcaatcagcgcgcagcgttcggcgtgctgtttatcacgcccctgcacccagctgtagccgagcgtgccgtcagtcaggcgcacggcggcgcgggtcagcgtggcgtcgccggcaaaaaaacgttcgccggtgccgcccatccgcgcctgaatctgtaccaggccagtttcagcggcgcggatcacctcatagtcggcggtgatgtttagcgcgttcaggcgtgctgccagttcagccggttggctgtgcgccagcacggacatccagtgctggcgggtcgcggtatctgcgtgcattcagtgctccatagtgaattcaatcatgtcggcgcgcgtcaggctgacggagtactccgccgggctgctttcaccgtcacggtggttaagggtgcgcacgcacagcagcggcgacatattcgggatttcaagacgctggcactctttggcctgggcgcggcgggcgctgatccgcgtctggctgcggcgcagcgcaattccggtttgctcgcgcagaaaatcgtgcagcgagccgctgtcgaagcgttgcagcgtcggccagagggtgaggtccgcgaagtagtggtcgattaaacagagcgcgacgccgttgacacgacgcagggtgcgcaggtggatgacgttctccccctcggtaatccccagtgcgtcagcgacgtggccggacgcggggcgcaataccgaaagcagtttttcgctggtgggatggctgccctgatccagcagattctggctaaaacgcgcctgggcgttgagcgggtaatcgaacgggcgcatcagcaccagcacgccgacgccctgacggcgctgtacccagcctttttccaccagttggtcgatggcgcggcgcagggtgtggcgattcacctcaaagcgcgctgccagttgctgctcggcgggaagatagtcgccgcagcggtagtgttgacgaagctcctgctcaagttttgcggctatctcttgatagcgtgttgggtagctggtcggatgtgtagacaagtgcatagatatcaatgcctcgcttatcagataaagtgcttacgcaaccgttgagagaggaaatccagcaggctgaccgtgacgatgataagcaccatcagggcgcaggtttgttggaactggaaaccgcgaatcgcttcccacagggtgacgccgatcccgcctgcgccgaccatgccgacgacggtcgccgagcggacgttggattcgaagcgatagagggagtaggagatcagcagtggcatcacctgtggcagcacgccgtagaggatctcttcgagcttgttggcaccggtggcgcgaatgccttccaccgggccgggctcaatcgcttccaccgcttcggaaagcagcttggagagcacgccggtggtgtggataaacagcgccagcacgccagcacgccagcgaacgggccgaggccgacggcgaccacgaacagcatggcgaagaccatttcgttaatggcgcggcaggcgtccatcaggcggcgaacgggctggtaaacccaccacggcaccaggttttcggcgctcatcaggccaaaggggatggagagaaccaccgccagcgcggtgccccagacggcgatttgcagcgtgacggccatttcggtgaggtaatcctgccactggctgaaatcgggcgggaagaagtcggcggcgaacgtcgccatgttgccgccgtctttgatcagcgtaagcggggccatttccgcgccctgccacgagacgaccaacacggcgagtacaacggcccagctcagaagcgagaaccagctgcgcttgggtggggcgatggtgatggtttgcatgtttggctccggtctgtaggccggataaggtgcttgcaccgcatccggcatcaacgcctgcacattgtcggatgcgacgccggggcgtcttatccgacctacgatttactgcaccgctttactcaccgaactcatcgcgcttagcgcgttgttcaggcggtccaggtcatccagctgcgcctgaatctcggtggtttttgccagcttgtcctgctcattcagtcctttattgcttttcacgccctgcatctctttaaacagcgcgagctggcgaatcggcaccagttgcaggtcgctggaagcgcggaatggcgcccagcccaggcgttccagcaccgctttttcttccggcgttttgccgtagttcataaagaagtcgtagatcttgtctttggtggtttcggaaagattcttgcgccagacgatcggatcgcctgggatcagcggcgacttccagatcaccttcagttctttcagcttctctggcgcggaggttttcagcttgtcgaggttttcggtgttgttggtggcaacatccacctgcttgttggcgacggccagcgcgttggtttcatgcccggcgttgacggtgcgcttgaagtcgctggcggagatattgtttttggcgaagacgtagtagccggggacgaggaagccagaggtggagttaggatcgccattgccaaaggtgagatctttccgcttcgccagcagatcgttcaggttgttgatcggactgtctttgttgacgatcaacacgctccagtaacccggcgatccatccgccgcgaccgtctgggcgaagacctggccattggcgcgatccaccgcttccatcgccgacagattgccgtaccaggcgatatccactttattgaagcgcatcccctggataatgcccgcgtagtccggggcaaagaaggcgttgaccttcacgcccagcttcttctccatatcctgcaagaacggcgtccattgcggtttcaggttttgctgtgattccgttgaaataatgccgaaattcaacgccttttcctgctcttcggcgtgcgccgggcttaacagggtgctgaggctgaacatgctggtgaaggccagcgaggcaattatcttagcgttcattcgttttcctcaatgatggggatgtcaggcagctttcgcgttctcttcgacgcggttaatgctgcggtagagatggtcaaaacgttcgttatcaaactgttggctgctgccgtcgtagaagacgtgcccctggcgcagggcgacgatgcgttcgcagtagcgcagggcgtaatccacctgatgcagcgtgacgaccacggtgatgccgtcgttctggttgatgtcgcgcagggtgtccatcacgatgcgcgctgattctgggtccagcgaggcgatgggttcatcggccagaatcactttcgcctgctgcatcagcgcacgggcaatcgccacacgttgctgctggccgccggagagggtggaaacgcgctgatgggcaaaatgcaccatgccaacgcgggtcagcgcctgtaacgcgcgctgtttctgctcgccggtgaaccagctaaaacaggtgcgccagaacggcgtgctgccgagcgcgccaatcagcacgttctccagtacgctcaggcggttcaccaggttgaattgttggaatatgtagccggtatgggcgcggcttttgcggatatcgcgggccaggcggccttcgcgctggactgtgcggcccagcagctcgatatggctaccgacagatttatcgccggtaatcaaaccgcttaagtgacgtaaaagggtggattttccggaacccgacggcccaagcagagccaccatttcaccgtgatgaatgttcagatcaaccgcatgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacggga

SEQ ID NO: 21 - protein, 348 aa, Artificial Sequence
  Description of Artificial Sequence; note = synthetic construct
MKKWSRHLLAAGALALGMSAAHADDNNTLYFYNWTEYVPPGLLEQFTKETGIKVIYSTYESNETMYAKLKTYKDGAYDLVVPSTYYVDKMRKEGMIQKIDKSKLTNFSNLDPDMLNKPFDPNNDYSIPYIWGATAIGVNGDAVDPKSVTSWADLWKPEYKGSLLLTDDAREVFQMALRKLGYSGNTTDPKEIEAAYNELKKLMPNVAAFNSDNPANPYMEGEVNLGMIWNGSAFVARQAGTPIDVVWPKEGGIFWMDSLAIPANAKNKEGALKLINFLLRPDVAKQVAETIGYPTPNLAARKLLSPEVANDKTLYPDAETIKNGEWQNDVGAASSIYEEYYQKLKAGR

SEQ ID NO: 22 - DNA, 11749 bp, Artificial Sequence
  Description of Artificial Sequence; note = synthetic construct
acatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccatcagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtggcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccagaagatgttccagatccgtttatcgagacaatttccccacggtacgctgtcgatatagcggcgaatcaaatagccggatataaagaaaaaaaccggcatacgaaagggggcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgacccgaggtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccagaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcggatgcccaacaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggtgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccatcgttgaccctgacctggtcgtcattggtggtggcttatcgaatttcccggcaatcacaacgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagtgcgttgttcacaaagtggtcaggttctcgactggacaggagacgttaccccagaagataaatgccattgttgccagtttccggcacccttgcgcccgcacgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggacgcaattaattgaatttgcgggttttgtgggccggataaggcgttcgcgccccatccggaataatacacgcgcacttttccggcctcttttatcgtttactcgtcaataacaatgcggcaataaacgtacagacaccaattagccctgcccagagtggcgatattctggtaatcgcaaagctattatcgatatacaaacataaagcctgataacccatattggcaatagtcatcgccactgcaaattttaacgcataaataaaacgagtcgtgtagtaaaagatcctggaaaataagataaacgtcgcagcccaggcgataaaacctaatgtgttggtgctgccggggggagcattttcatgctgttgtcctggatgcggataatacgttagtggcggcgtcgattgttttaatatctgtgcttgtagaacagccaatgcattattgattccctgataccagagatctgcatttaaataagccagcgtgtgattttctatcagaaggccgagatgtttatcgtccagaccactttcaacctggccgttggtgatcataattaaccgtggttcgcgggtagtaaatagtaacagaacacttccttttacatcactcaatgaagatgacgcatgcgccagcatcgctttaccattttgtctgagactggcttcattattaatgtcgggtaaaaccacaataaacggtgcaattcccgtttgttggcgaaaaagctcggctttatgcgcgatctcttcagcatctggtacagtaccggtaacgtccgtaaaaagtgtcttcattattggaattaatggcttgctggctgctgtcagaggcaggagtatcagtaaactgagcagtataatgaattttttcatgggcgggacttccgtttcctgcgtgattttttagaggagggcatacttattaataaaccgacggcgataaaaataacgcccataatgccgataaacccccatttaaaaaaattaacccacgggttatttatctcagccttttcaggatgcccgggagaataataaacattaactttatcgccttcgctgtcttcataaaaatcgctgccgatactcgaattgaaaattagcgtgtaatctggcgtcggtcgaaaggcaacgacgggataccacgaaccatctttacccgtgcgatgagaatgactggagtgccagacggtatcaacaatgacgccttcggtatgaatcgcgtctttgctataggtgaactggttataaaagacaacaacagaaatgaggatcagtaccagaccgataccgaggaatatacgaaagaaaactttactgtcctgactcattagccacatccttgctaactaaaaaacgggcggtaataccaccgcccgcttgctgaattaacgtcctgctttcagcttctgataatactcttcataaatgctgctggctgcgccaacgtcattctgccattcgccatttttaatggtttcagcatccgggtagagtgttttatcgttcgccacttctggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctggcgtgcaacgaaagcagaaccgttccagatcatgccgaggttaacttcgccttccatgtacgggttcgccgggttatcggagttaaaggctgccacgtttggcatcagttttttcagctcgttatatgcagcttcaatctctttcggatcggtggtgttaccggagtagcccagcttacgcagcgccatctggaacacttcacgggcatcgtcggtcaacagcaggctgcctttgtactctggcttccacagatcggcccagctggtgacagatttcggatccaccgcatcaccgttaacaccaatcgccgtcgcaccccagatatacggaatggagtagtcgttattcgggtcaaaaggcttgttgagcatgtctggatcgagattgctgaagtttgttaacttcgacttgtcgatcttctggatcatcccttctttacgcattttatcaacgtaataggttgaaggaaccaccagatcataggcaccgtctttgtatgttttcagcttggcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcataacttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcattcgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaagccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcaaacgagaagcgcgccagtaaaccagcaacatcaggcccattacgatagtcagcgtaatgctggtagctgcaccaaacggccagtcacgaatattaaggaactggaccttgatgacgttaccgatcagcaggtttttcgcaccgcccatcaggtcggatacatagaacaggcccatcgctggcagcatcaccagcagacatccggcaataattcccggcatcgtcagtggaataatgatacggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaattaatgagttggtccagaacggaacaatcagcagaaacagcagcagcggacgcaccttgtgtggcaacttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacaaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagttcaacaaccgactccagcgtcatgcctttgtagttacgctcgcgaacgtaaccaatcagcccttcagcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtctagacgttcgatgacagtggcgttaaacatattgatttcgccaatgaagccggcaacaaacaggtttttcggctcttcgtagatttcacgcggcgtgccgtcttgctcaatgcgaccatcgcgcatcaccacaatcctgtctgacatggtgagtgcttcttcctggtcgtgagtcacaaagacgaatgtaatgccaagcttacgctgtaacgctttcagctcgttctgcatttgcttacgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccaactgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctga

SEQ ID NO: 23 - protein, 370 aa, Artificial Sequence
  Description of Artificial Sequence; note = synthetic construct
MTALNKKWLSGLVAGALMAVSVGTLAAEQKTLHIYNWSDYIAPDTVANFEKETGIKVVYDVFDSNEVLEGKLMAGSTGFDLVVPSASFLERQLTAGVFQPLDKSKLPEWKNLDPELLKLVAKHDPDNKFAMPYMWATTGIGYNVDKVKAVLGENAPVDSWDLILKPENLEKLKSCGVSFLDAPEEVFATVLNYLGKDPNSTKADDYTGPATDLLLKLRPNIRYFHSSQYINDLANGDICVAIGWAGDVWQASNRAKEAKNGVNVSFSIPKEGAMAFFDVFAMPADAKNKDEAYQFLNYLLRPDVVAHISDHVFYANANKAATPLVSAEVRENPGIYPPADVRAKLFTLKVQDPKIDRVRTRAWTKVKSGK

SEQ ID NO: 24 - DNA, 11756 bp, Artificial Sequence
  Description of Artificial Sequence; note = synthetic construct
atgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcagaatgccagcaggtcagtgacctggctgtgaatcgagataaagccgatgcgatcggcgatggtttttacgcggcgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagttccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttactaagcgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactgaaaatcatcgcgttcattgctcaatttctcagccagatcttttgcacgcacacagtaagggcaacccgaacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagcgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaggtgaatgcgtcgccggggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgatgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatatgcataaaaatttgttaaataccgttttttaatccgagctatagtctcaaaccctggctaaagttattcttgcgatgcttttatatagcgagcagtgctggccgggagaaagttctcttttcttacaccgcgccgataaaaaatatgcacgtttattgcatatctttcagtgtgacaacttttgttcgtttgttaacgaactttcagaaggaaagagatatgaccgccttaaataaaaaatggctatcgggtctggttgcgggtgctctgatggccgtctctgtcggcacgctcgcggctgaacaaaaaacactccacatttataactggtctgattatatcgccccggacacggtggccaattttgaaaaagaaaccggtattaaagtcgtctacgatgttttcgactctaacgaagtactggaaggcaaattaatggccgggagtaccggctttgatctggtggttccatctgccagctttctggagcgccagttgactgcgggagttttccagccgctggacaaaagcaaattgccggagtggaagaatctcgacccggaactgctgaagctggtcgccaaacacgatcccgacaataaatttgctatgccctatatgtgggcgacgaccgggattggctataacgttgataaagttaaagcggtgctgggcgaaaacgcgcccgtcgatagctgggacttgatcctcaaacctgaaaatctggaaaaactgaaaagctgcggtgtctctttcctggatgcgccagaagaagtttttgctaccgtgttgaattatctcggcaaagatcccaacagcactaaagcggatgattacaccggaccggcaacagatctgctgttaaagctgcgcccgaacattcgttatttccattcatctcaatacattaacgacctggcaaacggcgatatttgcgtcgctatcggctgggcaggtgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgcccggatgtagtagcgcatatttccgaccatgtgttctatgccaacgccaataaagcagccacgccgctggtgagtgcggaagtccgtgagaacccaggtatttatccgcctgcggatgttcgtgcgaagctgttcactctgaaagtgcaggatccgaaaatcgaccgtgtgcgcacccgcgcgtggaccaaagtgaagagcggaaaataatccgcagtcgtagatgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctggcggagatggcgcgcgctattccaccttataccgaactgatggagtgggctgacgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctatggcaagagtttttcaataaccgcgactggccggtggcctcggcggtagcgatcatcatgttgctgctgctaattgtgccgataatgtggttccacaaacaccagcaaaaaagcgtgggagaacacggatgaataatttaccggtagttcgttcgccctggcggattgtgattttgctgctgggctttacctttctctacgcgccaatgctgatgctggttatctattcgtttaacagctcgaagctggtgacggtgtgggccggctggtcaacgcgctggtatggtgagttattgcgcgatgacgcgatgatgagtgcggttggtttaagtctgacaattgcggcctgtgcggcgacggcggcggcgatcctcggaactattgcggcggtggtgctggtgcgctttggcaggtttcgcggatcaaatggctttgcctttatgatcaccgcgccgctggtaatgccagatgtcatcacgggcttgtcgctgttgttattattcgtcgcgcttgctcatgccattggctggcctgcggaccgcggtatgctcaccatctggctggcgcatgtcactttttgtacggcttatgtggcggtcgttatttcttcaagattgcgggaactggatcgctcgatagaagaagcagcgatggatctcggtgcgacgccgctgaaagtgtttttcgtcattacgctaccgatgatcatgcccgcgatcatttctggctggttactggcttttactttgtcgcttgatgatctggtgatcgccagctttgtttccgggccgggagccaccacgttaccgatgctggtcttttccagcgtgcggatgggggtgaatccggaaatcaacgccctggcaacattgatcctcggcgcggtcggaattgtcggatttatcgcctggtatctgatggctcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggttttcattgagatctggtgtgcgttttcactggtgaaagggcgtcgctgggcgcgctggctatatctgctgacacaaatcaccgccgcaagttacttgtgggcggcttcgctggggtacggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataatgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgcgatggcacaccagaagacctttgtgactgcccgctttatcctgcctcatttgcgcccgtttttgcggcgctaaaaccgtttatcgcccgagcggggttaacgccctacaacgtggcgcgtaagcgtggcgaactgaaatacattctgctgactgaaagccagagtgatggaggcatgatgctgcgctttgtactgcgttctgataccaagctggcgcaactgcgtaaggcgctgccgtggttacacgaacaactaccgcagctgaaagttattaccgtcaatattcagccggtacatatggcgattatggaaggggagacggagatctacctgaccgaacaacaggcactggcggagcgttttaatgacgtaccgctgtggatccgtccgcaaagtttcttccagactaatccggcggtcgccagccagttgtacgccaccgcgcgcgactgggtacgacagctgccggttaaacatatgtgggatctgttctgcggtgtggggggctttggtttacactgcgcgacgcctgacatgcagttaaccgggatcgaaattgcatcagaggccattgcctgtgcaaagcagtcagccgctgaactgggcttaacgcgtttgcaatttcaggcgctggactccactcagtttgccaccgctcagggggatgtgccggagctggtgctggttaacccgccgcgccgcggcattggtaaaccgctgtgtgattatctctcaacgatggcaccgcgttttatcatctactccagctgtaacgcccaaactatggcgaaagatatccgcgaactgcctgggtttcgtattgaacgggtgcagcttttcgatatgttcccgcataccgcgcactatgaagtgctgacgctgctggtgaagcaataaaaaagccgcatgtgcggcttcagattgctgacaaagtgcgcgttgtttatgccggatgcggcgtaaacgccttatccggcctacaaaagcgtgcaaattcaatacattgcatgggccatgtaggcct

SEQ ID NO: 25 - protein, 192 aa, Artificial Sequence
  Description of Artificial Sequence; note = synthetic construct
MYQDLIRNELNEAAETLANFLKDDANIHAIQRAAVLLADSFKAGGKVLSCGNGGSHCDAMHFAEELTGRYRENRPGYPAIAISDVSHISCVGNDFGFNDIFSRYVEAVGREGDVLLGISTSGNSANVIKAIAAAREKGMKVITLTGKDGGKMAGTADIEIRVPHFGYADRIQEIHIKVIHILIQLIEKEMVK

SEQ ID NO: 26 - DNA, 9931 bp, Artificial Sequence
  Description of Artificial Sequence; note = synthetic construct
acattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaacgaactgaacgaagcggcggaaacgctggctaactttttaaaagatgacgccaatattcacgccattcagcgcgcggcggtcctgttagcagacagctttaaagccggtggcaaagtgctttcctgcggcaacggcggttcccattgcgacgctatgcactttgccgaagagttgaccggtcgctaccgtgaaaaccgtccgggctacccggcgattgctatttctgacgttagtcatatttcctgcgtcggtaatgatttcggtttcaatgatattttctcccgctacgttgaagcggtaggtcgcgaaggcgatgtactgctggggatctccacctccggtaactctgcaaacgtgatcaaagcgatcgcagcggcgcgtgagaagggaatgaaagtgatcaccctgaccggtaaagacggcggcaaaatggctggcacggcggatatcgaaattcgcgtaccgcactttggttatgccgaccgcattcaggagattcacattaaagtgatccatatcctgatccagttgattgaaaaagagatggttaagtaagtctggcgtaggccggataagacgtttacgccgcatccggcatttgtgcgctgatgcctgatgcgacgctgacgcgtcttatcatgcctacaaatctgtacgcgaaccgtaggccgaataatgcgttcacgccgcatccgacctgaaaattcttaaatcaatcttcgccgggggccatgcgctcccgctgttgtggaggttacccatgtgcgaattgctcgggatgagcgccaacgtccctaccgatatctgctttagtttcaccgggcttgtacagcgtggtggtggaaccgggccacataaagatggctggggcattaccttttacgaaggtaaaggctgtcgcacatttaaagatccacaacccagctttaattcccccatcgccaaacttgtccaggactacccgataaaatcctgttcggtggtggctcatattcgccaggctaatcggggcgaggtggcgctggaaaatactcacccatttacccgcgagttatgggggcgtaactggacttatgcccataacggacaactgacgggctacaaatcactggaaaccggcaacttccgcccggtaggcgaaaccgacagcgaaaaagccttctgctggctcctgcataaattaacgcagcgttacccgcgcacaccgggcaacatggcggcggtatttaaatatatcgcctcactggcggatgaactgcggcagaagggcgttttcaacatgctgctttcggacgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcaacacagccgctgacgggcaatgaaacctggcaaaagattatgccaggcgaatggcgcttattttgcctcggggagcgtgtagtttgatgccagttgtggctgcacaacttcgtggcttaacggcttgctgaccacgtaacgaccattgaccacagaaacggttggtggcttacgggtttgctcaaagtagtcgtaacccggcttcagttgctcccagaagtccttaaagttggaatatttatggcgcttcatattggcgtcggtcatgcggaacgggtaaatactcacttgcacgctcggctgaccaaacaccagcgcaccagtaacgaactggaatatctcatcaataccctgattggtcattgcgtagcagccgatggaaacacaatcgccgtggatcatcaggtatttcccttcataaccatgcgcacggtcataggcattggggaaaccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcacaggcgtggtagagctactgctgcccagcaaaccggcaaatgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggaagcgggctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagtattattgataagaagcgtcataagatatttcaatttattcatatccttatgacgcttttgtgcaagttttacatcctttgaatattgtcccgagtattcaatatccctttgaatcatatttaaattcctaatttatcaaataaatcatcggcgtctttggccttatgaacatcaatgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgctgcctgattcttcagatcttcatcgattcgggcgcgaacaaacgcgttagcagccattggggtatctcctgtgctgtatatttattcagcttgaattgtagctcaaatgagcaacagcgacaatccatgagtaatttaataaacggatgtttttacataattaactgaaatatatatgttaattttataataatggtttattaagtttgttcagaaacgatccgggatacactgcaacattaaagcatgaccagccattattgagtatgtccttgccgtcgattccatcctttgtattgtcgggattactgttgatttgtttgccgttttcttcatttgccagcgccaccacatcacatatctctttcagctacgccgcccgccagcggatgcaaaaccgtgcgcgtttattaaaacagtaccaaactcatctgaaaaagcaggccagctatattgtggaaggcaatgccgaaagcaaaagggcgctacgccagcacaaccgggagcagataaaacagcatccagaatggtttcctgctccgctcaaggcgagtgacagacgctggcaggcgctggcggaaaacaaccactttttaagcagcgaccatctgcataacattaccgaagtggcgattcaccgcctggagcagcagcttggcaagccttacgtctggggcggtacgcggcctgataaaggctttgactgtagcgggttggttttttatgcctacaacaagatccttgaggctaagctcccgcgcacggccaatgagatgtaccactatcgccgggcaacgattgtggcgaacaacgacctgcgccggggagatttgctgtttttccatatccacagccgcgagatagccgatcatatgggcgtgtatttgggcgatgggcaatttatcgagtcgccacgtaccggcgaaaccattcggataagccgattagccgaacctttctggcaggaccattttttgggcgcgcgcaggattttgacggaagagacgattttgtaggacggataaggcgtttacgccgcatccggcagttgtacgcaggtgcctgatgcgacgctggcgcgtcttatcatgcctacgagcccgcgaatatttgcgagccgctttcccgatataaaacaacctcattgccaacctttccttttcttcttaccgttgagaaaaaggagtcgccatgtctgaatatcgtcgttattacatcaaggggggaacatggtttttcacggtgaatttacgaaatcgtcgaagccaacttttgaccacccagtaccagatgctccgtcacgccattattaaagttaagcgagacaggccttttgaaatcaacgcctgggtcgttttgccagagcatatgcactgtatctggacattacctgaaggcgatgatgatttttcctcgcgctggcgggaaattaaaaagcaatttacccatgcttgtggattgaaaaatatctggcaaccacgtttttgggagcacgccatccgcaataccaaagattataggcatcatgttgattatatttatataaatccagtaaagcatggttgggtaaagcaagtgagtgattggccattctcaacgttccatcgcgatgtcgcgcgagggttatatcccatcgattgggcgggggacgtaacggattttagtgccggggagcgtatcatttcataattgtgcgcagatgcctgatgcgacgctagcgcgtcttatcatgcctacaaacttgtgccggatcggtaggccggataaggcgtttatgccgcatccggcagttatgcgcagatgcctgatgcgacgctggcgcgtcttatcatgcctacaaacttgtgcctgaacggtaggacggataaggcgttcacgccgcatccggcagttgtgcaccaatgctggatacttacatcaacgcccccataatcttcaactccagctcatccggcacttcgttatacgacagcacatgcagccccggcgcaaacaaccttgcataacgcgccagcaaagggcgcagctgcggtggcaccagcagcaccgggtctttccccgccgctttcatctgctctttcacctgtggcatcgtactctggaactggttgagcatattcggatcgaccggcacgctgtcgagcatcactttcccgccctgttgcgcctgattcaccacgttggtcagcagattttccagctcattattcagcgtatacaccgtcagctcctgcttgcgaacgaacggatgggtaatgctgcgccgcaatgccaggcgcacatcggccgccagcagaatatgatctttcgtcaccgtgctactggcgaccagcacggtggcgatggtgacgatatcgcgcagggaaacgccttcggtcagcagcgcccggtacactttcagcaactggctgtaattgagcgccgcgctcaaatcttccgccagacgcggtgccgtcgacgataaacggttatgcaactgcgtaatatcatcatagttaaacaaatcaggaatatagctgcgcacaatcttatttacatgggtagcgatcacgctggcgctgtcgatcacctgataccccatattcagcgccttcgctttctgcgccgcctggatccaggtgaccggcatcccgtacgccgggtcgttcccctgcacgccgtcaatctcgccgtaggtttcgctggagggcagggccatcagtttatccgccggaatatccgcttcatcagcctttatgccgttgatgaaaatggcgtactgactgggcttaaggcggaagttttcccgaatgcggatctccggcagcagcacgccgttgccgtcagaaatcacctgccgcacgccgcgaatccgctgggtgagcgggttaccctgtgctttgtccaccagcgccaccagtttgtaaccgaggcttaaactgataggctcgatcagcggaatggtttcccaactgacctgctgctcgctggtttcggtgatggtgcgggtcagcgtttcgaggcttttctcttccgcctccgccgccagcggctgtttgctcatccgccagccggtaaaaccaagcagggcgctgaacagcaaaaacggcaggtgcggcattcccggtaccaccgccagcacgaacataatcccggtggcggtgtagagcaccgacgggcttgccagcagctggttacgcacgtcatgggcgatatcgccgttgtcgctgacgcgggtgacgataatcgccgccgcggtggagagcagcagggaagggatctgcgccaccaggccgtcgccgatggtcatcagcacatactgctggaaggcagcatcggcgctcaggttgtatttgaagatcccgatacagacgccgccgatcaggttgatcgccagaatcatcatcccggcgatggcgtccccgcgcacaaacttcgatgccccgtccatcgcgccgtagaaatcggcctcgctggcaacatctttacgccgggtttgcgcctgcgcctggttgatcaatccggcgttaagatcggcgtcaatcgccatctgtttgccgggcatcgcgtctaaggtaaagcgggcagaaacctcggaaatacgctcggcccctttggtgacgacaataaagttgattgtcaacagcgtcagtaaatccgagcgtgaaagcattatcgccgcgctgcacgggcagtcgatttttaacggtggtgggctgtcgccgttaaataaaatcagcccgtctcatccgccaaaacctgccaccgtggcggtgccggaagagacggagaaaaaagcgcgtgatgtgaatgagaaaacggcgctgctgaagaagaaatccgccaccgagcttggtgagctggcaaccagtatcaacaccattgcccgtgatgcgcatatggaagcgaatctggagatggagattgttccccagggattacgcgtgctgattaaagacgaccagaaccgcaatatgtttgaacgcggcagcgcgaagattatgccgttctttaaaacgctgctggtggagctcgcgccagtgttcgactcgctcgataataaaattattattaccgggcataccgatgcgatggcctacaaaaacaatatctacaacaactggaacctttcgggtgaccgcgcgctttcggctcgtcgggtgctggaagaggccggaatgccggaagataaagtgatgcaggtaagcgcaatggcggaccagatgctgctggattccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgaacgcgttaaatgctgaatctttacgcatttctcaaaccctgaaatcactgtatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgatgtatactattatgtatattctggtgtgcattattatgagggtatcactgtatgcatcgaattctcgctgaaaaatcggtcaatatcactgagttacgtaaaaacccagctaaatactttattgatcaaccggttgcggttctttctaataatcgccccgcaggatatctcttaagtgccagcgcattcgaagcgttaatggacatgcttgctgaacaagaggagaaaaagcccataaaggcgcgcttccgtccaagtgctgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgatgcgttaacggcggattttatttcctataagcgtgacggtgttttgccagatatatttggtcgcgatgcactctacgacgactcctttacctggccattaatcaaatttgagcgagttgctcatattcatctggcaaatgagaataatccatttccgccacagttgcgccaattcagcagaacgaatgacgaagcgcatttggtatattgtcagggggcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggcgattttcagcaactatgcgctattttcattagagcggttacgatgaccgccagtcagcattattcaccacaacaaatttccgcctgggcgcagattgacgaatctcgctggaaggagaaactcgcgaaatcacaagtgtgggttgcgatcattaatgcacaaccggttggttttatttcccgcattgaacattatatcgatatgttatttgttgaccctgaatacacccgccgtggggttgccagcgctttgttaaaacctttgattaagtctgaatccgaacttacggtggacgcaagcataaccgcaaaacccttttttgaacgttatggttttcagacagttaagcagcagcgcgttgaatgccggggagcgtggtttactaatttttatatgcgatataaaccgcaacattaaatccagcttgcaatgaaaataacgcccgcctggtatgtgcgcgttttctgattccacaaactgcaaggaggtaaatcatgacaaatcctttatcaatgactctttgcagacctttccaggattaattctttttttcttgccctggattcgtctgccatttcctgatttttatatttatata

SEQ ID NO: 27 - protein, 329 aa, Artificial Sequence
  Description of Artificial Sequence; note = synthetic construct
MNKWGVGLTFLLAATSVMAKDIQLLNVSYDPTRELYEQYNKAFSAHWKQQTGDNVVIRQSHGGSGKQATSVINGIEADVVTLALAYDVDAIAERGRIDKEWIKRLPDNSAPYTSTIVFLVRKGNPKQIHDWNDLIKPGVSVITPNPKSSGGARWNYLAAWGYALHHNNNDQAKAQDFVRALYKNVEVLDSGARGSTNTFVERGIGDVLIAWENEALLAANELGKDKFEIVTPSESILAEPTVSVVDKVVEKKGTKEVAEAYLKYLYSPEGQEIAAKNYYRPRDAEVAKKYENAFPKLKLFTIDEEFGGWTKAQKEHFANGGTFDQISKR

SEQ ID NO: 28 - DNA, 10208 bp, Artificial Sequence
  Description of Artificial Sequence; note = synthetic construct
gctattgagttcctgcctggatacttaccgcgaaaacagcacgcctgacataaaataaatatggtctaatggggaaatttctcgtggagagggaacagatgcgatatccggttgatgtatacacaggcaagattcaggcttatcccgaaggcaaacccagcgcaattgctaaaatccaggttgatggtgagttgatgctgacggagctggggctggaaggtgacgagcaggcggagaaaaaggttcacggcgggccagacagagcgctgtgtcattatcctcgtgagcattatctctactgggcgcgggaatttccggaacaggcggagttgtttgttgcgcctgcgtttggtgaaaacctctcaaccgacggcctgacggaaagtaatgtttatatgggcgatattttccgctggggagaggcattaattcaggtcagccagccgcgctcgccttgctataaactcaattaccattttgatatcagcgatatagcgcagttgatgcaaaacacaggtaaggtggggtggttgtatagcgtgatagcgccagggaaagtgtctgcggacgcgccgctggagttggtttcccgtgtcagcgatgtgaccgtgcaggaggctgccgccatcgcatggcatatgccgtttgatgacgatcaatatcaccgtttactctccgctgccgggttatcgaaaagctggacgcggacgatgcaaaagcgccgactgagcggcaagatcgaagatttttcccgccggttgtggggaaaataacccccggagtgtaggcctgataagacgctatcagcgtcgcatcaggcatcctgctcaaatgccggatgcggcgtaaacgccttatcctgcctgcaaatgcgaagtttaactccgcttatacagcggcaaccaaatcaccagccgtaaaccgcccagcgggctgtcttctgccttcacccagccacgatgctgctgaatggcggtttcaacaatcgccagccccaaacctgtaccgccagattcacgatcgcgtgcttcatcggtacgatagaacggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcggattgccgtacagcggccacggcccaggcgggaagttaactgtcaacgacttgcccatttgctcggcttcgaacgccgcgttatccagcacttcactccacaactggttggctttgatggtttcgctaaccagcgcgtttttttgctgattacgtgacatcaccaacagatcgttgatcatgctgtccagacgttgcgcttcggtttcaatacgctccagttccttgctttcaccgctacgacggcgcagtaacgccgtacccagttgcagacgcgtcagcggggtgcgcagctcgtgagagatatcagaaagcagacgctgctgagaggtcatcatgcgctccagcgcggtgaccatctggttaaaactggcacctgcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccaacatggtgacaatcagcagtaatagcgggcggtcaaacagtaagttaatgaaatcggattgagaactgctggccggacgaatcagataaagttggtaattatcttcgccatcacgcacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccaataacaaacgctgtcctggcggtgcccacttatcaatcgcccggaacagacgccgccaccacattaaatcgttgggcggatcgttcgccagctccgcttcgacatgctgctcaatcatcagcccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcagatagccgcgaccacgcaaggttttaaaccacgggtgaccatctttacgatccggcagtttacgacgcaggttggaaatgtgcatatcaatagcgcggtcgaaaggcgtcaggcgtttgcccaacacttcctggcttaaatgttcacgggaaaccacctgacccagatgctgtgccagcaaatagagcagggtaaactcagtaccggttaactccagcgtttgcccgtcgaagctggcttcctgacggcctggattcagcactaaggcatcaacttccagtgtcggtgaaccgttgtcgttgttttgctgttgctcgctccagtgcgaacggcgcaggatcgcgcgaatacgtgccaccagctcacgatcattaaacggtttcgggagatagtcatctgcgcccagctcaaggccgagaacgcgatcaagttcactgccgcgcgccgtcaacataatgacaggcgtctggtgtgtctggcgaagtgcttttaatgtgtcgataccatttttcttcggcatcattacgtcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactggcatccgggtgaagaacttacgcagcgcagacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaattgctcgtcaggttgagatggcaaaagtccgcaaccaaatgtatcgcctgttaacgccggagcagcaagcggttttaaacgagaaacatcaacaacgaatggagcagttgcgtgacgtgacgcaatggcaaaaaagttcatcgttgaagctattgagtagtagcaactcacgttcccagtagtaaaccctgttttccttgccatagacaccatccctgtcttcccccacatgctgtgggggttttttttatcctcaatttgcctgctgcttaatgcattgcagatgatttgcttccgttatactagcgtcagttgatagcgggagtatttatgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttattggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctgatatctccaacaccgatgacagatccaggcgtcggggttatcgtgacaattgtggcgctaatttgtacgattatccttgtctcgtttcagcgttgggtggtgcggcggacgcaaagccaggcggtgcgggctgatatgctacattaccagtctgatgttatgatgaacggcgcaattctgctggcgctggggttgtcctggtacggctggcatcgcgccgatgctctgtttgcattgggaatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtaattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcacttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaatgatttcggaaaaaggcagattcctttaccctgaaaccgatgacagaagcaaaaatgcctgatgcgcttcgcttatcaggcctacatgaattctgcaatttattgaatttgcaaacttttgtaggccggataaggcgttcgcgccgcatccggcatggacaaagcgcactttgtcagcaatatgaggcggatttcttccgcctttttaatccctcaacatatacccgcaagttatagccaatctttttttattctttaatgtttggttaaccttctggcacgctttgctcatcacaacacaacataagagagtcgggcgatgaacaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggtgataacgtggtgattcgtcagtcacacggtggctcaggtaaacaagcgacgtcggtaatcaacggtattgaagctgatgttgtcacgctggctctggcctatgacgtggacgcaattgcggaacgcgggcggattgataaagagtggatcaaacgtctgccggataactccgcaccgtacacttccaccattgttttcctggtacgtaagggaaatccgaagcagatccatgactggaacgatctgattaaaccgggtgtttcggtgatcacgcctaatccgaaaagctctggtggcgcgcgctggaactacctggcagcctggggctacgcgctgcatcacaacaacaacgatcaggcaaaagcacaggattttgttcgggcactgtataaaaacgtcgaagttctggattctggcgcgcgtggctccactaacacttttgtcgagcgcggaattggcgatgtactgattgcctgggaaaacgaagctctgctggcagcgaatgaactggggaaagataaattcgaaatcgtcacgccgagtgagtctatcctcgcagagccaaccgtgtcggtggtcgataaagtggtcgagaaaaaaggtactaaagaggtggcggaagcctacctgaaatatctctactcgccagaaggtcaggaaattgccgcgaaaaactactaccgtccgcgcgacgctgaggtggcgaaaaagtacgaaaatgcgtttccaaagctgaagttattcaccattgatgaagagttcggcggctggacgaaagcgcaaaaagagcattttgctaacggcggtacgttcgatcagatcagcaaacgctgatttccccaggataattatcaaacccggtggtttctcgcgaccgggttttttatttgtcacgattttgcgttacccttgcatctctttgaggtacagggaaaaaaagatgaaaaaagcgggtcttctttttttggtgatgatagttatcgccgttgtggctgccggtattggttactggaaattaaccggtgaagagtcggatacattacgtaagattgtccttgaggaatgtttgcccaatcagcagcaaaatcaaaatccttcgccatgtgcggaagtcaaacccaatgccggatacgtggttttaaaagatcttaatggcccactgcaatatctgttgatgccaacgtatcgtattaacggtactgaaagtcctttgttgaccgatccttcaacgccgaacttcttttggttggcttggcaggcgcgtgattttatgagcaaaaaatacggccagccggttcccgatcgcgcggtttctttggcgatcaactcccgcaccgggcgtacgcaaaaccattttcatattcatatctcttgtattcgtcctgatgtgcgcaaacagctggataacaatctggcgaacatcagcagccgctggttgccactgccaggtggtttgcgcgggcatgaatacctggcgcgtcgggtaacggaaagcgaactggtacaacgcagcccatttatgatgctggcagaagaagtacctgaggcgcgggaacatatgggacgctacgggctggcgatggtacggcagagtgataactcatttgtattgctggcgacacaacgaaatctactgacgcttaaccgtgcttcagccgaggaaattcaggatcatcagtgtgagattttgcgttaaggcgaagagttaaggaaagtaagtgccggatatgaaatccggcacctgtcagacttaagcctgtttagccgcttctgcagctttaacgattactgcgaaggcgtcagctttcagagaagcaccaccaaccagcgcgccgtcgatatccggctgagcaaacagttctgcagcgttagacgcgtttacagagccgccgtactgaatgatcacttgttcagcgatgttagcgtcaactttagcgatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcgcaaacttcttcagttttgcccgcttcattttcagcttcggtttcaccgatgcacagaaccggagtcaggccctgctctttcagcaccgcgaattttttcgcgatcagttcgtcagattctttgtggtaagtacgacgttcagagtgaccgatgatgatgtactgtgcgccgatgtctttcagcatagcagcagaggtttcaccggtgaatgcgccggacaggttcaggtccacgttttgcgcacccagcatgatgtggctgccttcagcttcgcgcttcgccatatcgatatacatttccggtggtgcgattgcaaccgcacagccagcaacacctgccagctctttacgcaggttagaaaccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgtgttttggtcattaatggggtgagtgtgcggatcaccgctgccatgtattcctgagctttcgctttcgcggctttttgctctggcccctggatgggtagccaggtcatttgaatgcttttgatttttaaggtaccgcgctccagcgctgtagaagcatacaagttctcattaattttacttgcagcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgcctctgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacgccgtgatttctggatttggataggcctgtggttcgcaggcatgctggtgcttttctcactggcgggtaagaatctactcgatattcagaccgcggcgttttgccttgtgtgcttgctctggccaacagcggcagtaactgttaagcgcttgcatgatcgcgggcgttccggcgcatgggcatttctgatgattgtggcgtggatgctgctggcgggtaactgggcgattttaccgggtgtctggcaatgggcggtggggcgttttgtcccgacgttgattctggtgatgatgcttatcgatcttggtgcgtttgttggcacacaaggcgaaaataaatatggtaaagatactcaggatgtgaagtataaagccgacaataaatcaagtaattaacctttaatatatctcttactgctatttttttccgggattgttatttccacgatgcaaatgacaatacccggaaaatccttctgaactcttcaccttaagcaatatcaaaaaaaatggtaatccataagatcattacttgtttgttcttcccttaacggcgcattattcttaagtcgt

SEQ ID NO: 29 - protein, 339 aa, Artificial Sequence
  Description of Artificial Sequence; note = synthetic construct
MKIPIPSIGHVALLASAILFASSANAASDEDGIIIYNAQHESFAKSWAEGFTKDTGIKVTLRNGKDSELGNQLIQEGSSSPADVFLTENSPAMVLVDNAKLFAPLDAATQAQVAKEYRPEDGRWTGIAARSTVFVYNPAKISEAELPKSLMDLAKPEWKGRWAASPSGADFQAIVSAMLALKGEQATLEWLKAMKTNATAYKGNSTVMKAVNAGQIDGGVIYHYYPFVDQAKTGENSGNIKLHYFKNKDPGAFVSISGAGVLASSKHPQQAQKFVQWVTGKAGQDFLRESNSAFEYAVGVNAASNPKLVPLKDLDPPKVEVSKLNSKKVVELMTEAGLL

SEQ ID NO: 30 - DNA, 1020 bp, Artificial Sequence
  Description of Artificial Sequence; note = synthetic construct
atgaaaatacctataccctctattggccatgttgctttactggcgtctgcaatcctgtttgcaagctctgccaatgctgcctcagatgaagatggcattatcatctacaatgcgcagcatgaaagttttgcaaaatcttgggctgaaggtttcaccaaagatacgggtatcaaagtcacgctacgtaatggtaaagacagtgaattgggcaatcaattaatccaagagggcagttcatcgcctgccgatgttttcctaaccgagaactccccggccatggtgttagttgataatgccaaattgtttgctccgctggatgccgcaacgcaagcgcaagtggctaaagaataccggcctgaagatgggcgctggaccggcattgccgctcgcagcacggtatttgtttataatccggcaaaaatcagcgaggcagaactgcctaaatccttaatggacctggcgaaaccagagtggaaaggccgctgggcagcttccccctccggtgctgacttccaggcgattgtcagtgcgatgcttgcgctaaaaggtgaacaagccaccttagagtggttaaaagccatgaaaaccaatgcgacagcgtataaaggtaatagcacagtgatgaaagccgtgaacgccggccaaattgatggtggcgttatttatcattactatccctttgttgatcaagctaaaaccggtgagaacagcggcaatattaaactgcattacttcaaaaataaggatcccggcgccttcgtcagtatctctggcgcgggagtattggcttccagcaaacatccgcagcaagcccagaaattcgtgcaatgggtcaccggcaaagcggggcaggatttcttgcgcgagagcaatagcgcctttgaatatgcggttggcgtgaatgccgcttccaatcctaaattggtgccactgaaagatttggatccgccgaaagtagaggtgtctaaactgaacagcaaaaaagtggttgagttgatgaccgaagcgggtctgctgtaa

SEQ ID NO: 31 - protein, 330 aa, Artificial Sequence
  Description of Artificial Sequence; note = synthetic construct
MKIKNILLTLCTSLLLTNVAAHAKEVKIGMAIDDLRLERWQKDRDIFVKKAESLGAKVFVQSANGNEETQMSQIENMINRGVDVLVIIPYNGQVLSNVVKEAKQEGIKVLAYDRMINDADIDFYISFDNEKVGELQAKALVDIVPQGNYFLMGGSPVDNNAKLFRAGQMKVLKPYVDSGKIKVVGDQWVDGWLPENALKIMENALTANNNKIDAVVASNDATAGGAIQALSAQGLSGKVAISGQDADLAGIKRIAAGTQTMTVYKPITLLANTAAEIAVELGNGQEPKADTTLNNGLKDVPSRLLTPIDVNKNNIKDTVIKDGFHKESEL

SEQ ID NO: 32 - DNA, 10164 bp, Artificial Sequence
  Description of Artificial Sequence; note = synthetic construct
ctgctattgagataattcacaagtgtgcgctcgctcgcaaaataaaatggaatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaaactgtcctctaactacagaaggccctacaccatgaaaataaagaacattctactcaccctttgcacctcactcctgcttaccaacgttgctgcacacgccaaagaagtcaaaataggtatggcgattgatgatctccgtcttgaacgctggcaaaaagatcgagatatctttgtgaaaaaggcagaatctctcggcgcgaaagtatttgtacagtctgcaaatggcaatgaagaaacacaaatgtcgcagattgaaaacatgataaaccggggtgtcgatgttcttgtcattattccgtataacggtcaggtattaagtaacgttgtaaaagaagccaaacaagaaggcattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccggacaaatgaaagtgttaaaaccttacgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggtggggcaattcaggcattaagcgcgcaaggtttatcagggaaagtagcaatctccggccaggatgcggatctcgcaggtattaaacgtattgctgccggtacgcaaactatgacggtgtataaacctattacgttgttggcaaatactgccgcagaaattgccgttgagttgggcaatggtcaggaaccaaaagcagataccacactgaataatggcctgaaagatgtcccctcccgcctcctgacaccgatcgatgtgaataaaaacaacatcaaagatacggtaattaaagacggattccacaaagagagcgagctgtaagcgttacgccccagcgcggagcgggggcgtgatttctctccatgccgcgtgaatgaattggcttaggtggagtcgttatgccttatctacttgaaatgaagaacattaccaaaaccttcggcagtgtgaaggcgattgataacgtctgcttgcggttgaatgctggcgaaatcgtctcactttgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcatcaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcgattttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatattgggtattgccggactcgttggtgccggacgtaccgagaccattcagtgcctgtttggtgtgtggcccggacaatgggaaggaaaaatttatattgatggcaaacaggtagatattcgtaactgtcagcaagccatcgcccaggggattgcgatggtccccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattggccgtaccgacatccggtggcttctccgggctgaaatcactgaatttgcaggtcttcgtgatgattgcagctatcatcgcaatcatgctgttctttacctggaccaccgatggtgcctacttaagcgcccgtaacgtctccaacctgttacgccagaccgcgattaccggcatcctcgcggtaggaatggtgttcgtcataatttctgctgaaatcgacctttccgtcggctcaatgatggggctgttaggtggcgtcgcggcgatttgtgacgtctggttaggctggcctttgccacttaccatcattgtgacgctggttctgggactgcttctcggtgcctggaacggatggtgggtcgcgtaccgtaaagtcccttcatttattgtcaccctcgcgggcatgttggcatttcgcggcatactcattggcatcaccaacggcacgactgtatcccccaccagcgccgcgatgtcacaaattgggcaaagctatctccccgccagtaccggcttcatcattggcgcgcttggcttaatggcttttgttggttggcaatggcgcggaagaatgcgccgtcaggctttgggtttacagtctccggcctctaccgcagtagtcggtcgccaggctttaaccgctatcatcgtattaggcgcaatctggctgttgaatgattaccgtggcgttcccactcctgttctgctgctgacgttgctgttactcggcggaatgtttatggcaacgcggacggcatttggacgacgcatttatgccatcggcggcaatctggaagcagcacgtctctccgggattaacgttgaacgcaccaaacttgccgtgttcgcgattaacggattaatggtagccatcgccggattaatccttagttctcgacttggcgctggttcaccttctgcgggaaatatcgccgaactggacgcaattgcagcatgcgtgattggcggcaccagcctggctggcggtgtgggaagcgttgccggagcagtaatgggggcatttatcatggcttcactggataacggcatgagtatgatggatgtaccgaccttctggcagtatatcgttaaaggtgcgattctgttgctggcagtatggatggactccgcaaccaaacgccgttcttgattttgataaaaattttctcaaagccggttacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacagatcgagcaagcgctggctgatgtcgacgtccccattgttggggttggcggctcgtatcaccttgcagaaagttacccacccgttcattacattgccaccgataactatgcgctggttgaaagcgcatttttgcatttaaaagagaaaggcgttaaccgctttgctttttatggtcttccggaatcaagcggcaaacgttgggccactgagcgcgaatatgcatttcgtcagcttgtcgccgaagaaaagtatcgcggagtggtttatcaggggttagaaaccgcgccagagaactggcaacacgcgcaaaatcggctggcagactggctacaaacgctaccaccgcaaaccgggattattgccgttactgacgcccgagcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgattattagataaagaagaaatgccgctacagcgaattttggtcccaccagttcgcgtcattgaacggcgctcaacagattatcgctcgctgaccgatcccgccgttattcaggccatgcattacattcgtaatcacgcctgtaaagggattaaagtggatcaggtactggatgcggtcgggatctcgcgctccaatcttgagaagcgttttaaagaagaggtgggtgaaaccatccatgccatgattcatgccgagaagctggagaaagcgcgcagtctgctgatttcaaccaccttgtcgatcaatgagatatcgcaaatgtgcggttatccatcgctgcaatatttctactctgtttttaaaaaagcatatgacacgacgccaaaagagtatcgcgatgtaaatagcgaggtcatgttgtagcgatgatgagaattgtcggcgtcacatcaggtaacgctgcgtggttgtcggatgcggcgtgaacgccttatccgacctacccgccaggcatgataaaacgcaccaacaacgcttcaggctcgtagctcaactgcctgagacaaagtaaaaagccttatccgactgacaagtcggataaggctcaaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagctgcgcacgcgatttacggaacgaagagtaagccgggtgcgtattcaggttagtgacataggcgctcaccgattctttgacagaactaaactgtgagtaccctttcactttacctggcgcattggtacaacgtcctttcatcgatttcatgccgaacaggttgttgttgttgcgcgccagcttcgacgttccccaaccgctttctgctgcagccatcgtcgccaccatactggtggggataatgtctacgcgttcaagcaaggtattccacgggatttttcgcgtattaccggaccacttcaccttgtagcgtttggcgatgtctttcagacgcgcacgctcagcaggtgaccattggccctgatactgttttgaaatgagccagttacgttccgcagtaatggccgcattttggctggtaatgtaaggcattacggtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgtcttcgctaacacctcactcgaaaacaccagagtgagtaacataagaatcatcgccccatatcgtcgtatgggagtcaaaatcatcaggtctcctggtcggatttaatcattccaacaccttatatttttcacaaatttgagagttgaatctcaaatcatatcaaaaatagctgtcaagagcaccccaaggaatagtccaaatctgaaactatgtcacgtgttaacgattcagattggcgctaaatcgcagaaaatgtgggggttatcgcaaaattcagccgttttttgcgcgagatcgctcacccttgcttctcatcctgtggacttaccgctcagggatgagttttgtttggcttatcgctggcaaactgtctgaaatcgcagcaataaggactcatccgccatgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaacttttccggcttcccgttcgtcagtacctcgggaagccgccaaccaggataaaatgtcagccctaatcagcgttgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgttgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgtaactacgacggtccacaggggaaaacggagctactcacactgcttgccggaatgctgcgcgagaagttgggttgggatatcgaaccacagaatattgcactaacaaacggcagccagagcgcgtttttctacttatttaacctgtttgccggacgccgtgccgatggtcgggtcaaaaaagtgctgttcccgcttgcaccggaatacattggctatgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctgggcaatcaacacggcattccgctggtgattgataacgcttatggcgtcccgttcccgggtatcatcttcagtgaagcgcgcccgctatggaatccgaatatcgtgctgtgcatgagtctttccaagctgggtctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaaaatcgctgcctgattcataaaccggaaggagccattttcctctggctatggtttaaggatttgcccattacgaccaagcagctctatcagcgcctgaaagcacgcggcgtgctgatggtgccggggcacaacttcttcccagggctggataaaccgtggccgcatacgcatcaatgtatgcgcatgaactacgtaccagagccggagaaaattgaggcgggggtgaagattctggcggaagagatagaaagagcctgggctgaaagtcactaaaaattgcctgatgcgctacgcttatcaggcctacatgatttctgcaatatattgaatttggaa

SEQ ID NO: 33 - protein, 430 aa, Artificial Sequence
  Description of Artificial Sequence; note = synthetic construct
MIKSKIVLLSALVSCALISGCKEENKTNVSIEFMHSSVEQERQAVISKLIARFEKENPGITVKQVPVEEDAYNTKVITLSRSGSLPEVIETSHDYAKVMDKEQLIDRKAVATVISNVGEGAFYDGVLRIVRTEDGSAWTGVPVSAWIGGIWYRKDVLAKAGLEEPKNWQQLLDVAQKLNDPANKKYGIALPTAESVLTEQSFSQFALSNQANVFNAEGKITLDTPEMMQALTYYRDLTANTMPGSNDIMEVKDAFMNGTAPMAIYSTYILPAVIKEGDPKNVGFVVPTEKNSAVYGMLTSLTITAGQKTEETEAAEKFVTFMEQADNIADWVMMSPGAALPVNKAVVTTATWKDNDVIKALGELPNQLIGELPNIQVFGAVGDKNFTRMGDVTGSGVVSSMVHNVTVGKADLSTTLQASQKKLDELIEQH

SEQ ID NO: 34 - DNA, 12275 bp, Artificial Sequence
  Description of Artificial Sequence; note = synthetic construct
ttcgcaaaaattgttaaatctcaggcgtataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtcagggcaagcaaaagagatccttagcgagatgggatatacccacgttgagaacgccggtggcctgaaagacatcgcaatgccgaaggtcaaaggttaaaagaattcaccatgagcggcgcttatgcgccgtttttttttctgtcacaccttatttacatccccatagattatttgcgtcagctcacaaatacgctttttccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagtgaagcgggggagtggcaggatattcagcaactcggtgaatgcagtcatttaatgtttgattttgtctgcaaccatatgtcggcaaaaagtgaatggtttaaaaactatttacaacagcatccaggttttgaagatttttttattgccgttgacccgcaaaccgatctcagcgccgtcactcgcccgcgtgcgttaccgttattaacgccattccagatgcgcgatcattcaacgcgccatttatggaccacctttagtgacgatcaaattgacctgaattaccgtagccctgaagtgttgctggcgatggtggatgttttactctgttaccttgcgaaaggtgctgagtatgtccgcctggatgccgttggctttatgtggaaagagccgggaacaagctgcatccatctggaaaaaacacatctgattatcaaactgttacggtcgattattgataacgttgcgccaggtacagtgatcattaccgagaccaatgttccgcataaagacaacattgcttactttggcgcaggcgatgacgaagcacatatggtgtaccagttctcgctgccgccactggtgctgcatgcggtgcaaaaacagaacgttgaggcgctttgtgcgtgggcgcaaaacctgacactaccttccagcaacaccacctggtttaacttcctcgcctctcacgatggcatcgggctaaacccgctacggggcttgttgcctgaaagcgaaatattagagctggtcgaggcgttacagcaggaaggtgcattagtaaactggaaaaataatcccgacggtacacgcagtccgtatgaaataaatgtgacctatatggatgcgttaagccgccgtgagagtagcgatgaagaacgttgcgccaggtttatccttgcccatgcgattttgttaagtttccccggtgtgccagcgatatatattcaaagtattcttggctcgcgtaatgattacgcaggtgtcgaaaaactcggatataaccgtgcgattaaccgtaaaaaatatcacagtaaagagataacccgagaactgaacgatgaagctacattaaggcatgcggtatatcatgagttgtcgcgtttaattacacttcgtcgcagccataacgagtttcatccggataataattttaccattgatacgattaattcatccgtaatgcgtattccaagaagtaacgctgatggtaattgtctgactggattgtttaatgtcagtaaaaatattcagcatgtaaatattactaatctgcatggtcgggatctgattagtgaagttgatatattgggtaatgaaataacgctgcgcccctggcaggttatgtggattaaataaaaaggaacatctcatgattaaatcaaaaatcgtgctgttatcagcactggtttcatgcgccctgatttcaggctgtaaagaagaaaataaaacgaatgtatccatcgaatttatgcattcttcggtggagcaggagcgccaggccgttatcagtaaattgattgcccgttttgaaaaagaaaaccctggcatcaccgttaagcaagtgcccgtggaagaagatgcctataacactaaagtcattactctttcacgtagcggttcgctgccggaagtgatcgaaaccagccatgactacgccaaagtgatggacaaagagcagcttatcgatcgcaaagcggttgccacagtcatcagcaacgttggtgaaggcgcgttttacgatggcgtactgcgtattgtgcgtaccgaagatggtagcgcatggaccggtgttcctgtcagcgcctggattggcggtatctggtatcgcaaagatgtgctggcaaaagcggggcttgaggagccgaaaaactggcaacagctgctggacgttgcacagaaactgaatgacccggcgaataaaaaatacggcattgcgctgcctacagcagaaagcgtgttgacggaacaatccttctcccagtttgcgttatccaaccaggctaacgtctttaacgccgaaggcaaaatcacccttgatacaccagagatgatgcaggcactgacctattaccgcgaccttactgccaacactatgccgggttctaacgacatcatggaagtgaaagacgcctttatgaacggcaccgcgccgatggcgatttactccacctatatccttccggctgtgattaaagaaggcgacccgaaaaacgtcggtttcgtggtgccaaccgagaaaaactctgcggtctacggcatgttgacctcgctgaccattaccgccgggcaaaagaccgaagagacggaagcagcagaaaaatttgtcacctttatggagcaggcagacaacattgccgactgggtgatgatgtcgccaggtgctgcgctgccggtgaataaagcggtggtgactaccgccacctggaaagacaacgacgttattaaggcgctgggtgaactaccgaatcagctaatcggtgaactgccaaatattcaggtttttggcgcagtaggggataaaaactttacccgcatgggtgatgtgacgggttctggcgtggtgagttcaatggtgcataacgtcaccgtgggtaaagccgatctctctactacgctgcaagcgagccagaaaaaactggatgaactgatcgaacagcactaaacccaggacaggaatccgcaatgaacaggcttttttcaggtcgttccgatatgccctttgcgctgctgcttctcgcgcccagcttattactgctgggcggtctggtggcgtggccgatggtgtcgaatatcgaaatcagttttttacgtctgccgctcaatcccaacatcgagtcaacgtttgttggggtgagcaactatgtgcgtatcctctccgatcccggcttctggcattcgctgtggatgacggtctggtataccgcgctggtggtggcgggcagcaccgtgctcgggctggcggtggcgatgtttttcaaccgcgagttccgcctgcgcaaaaccgcgcgttcgctggtgatcctctcctacgtaacgccgtccatttcgctggtgttcgcctggaaatacatgttcaacaacggctacggcattgttaactacctcggcgtcgatcttctgcatctctatgagcaggcaccgctgtggttcgataatccgggcagtagctttgtgctggtggtgctgttcgccatctggcgctacttcccgtatgcctttatctcgtttctggcgattttgcagaccatcgacaaatcgctgtacgaagcggcagagatggatggcgctaatgcctggcaacggtttcgtatcgtcacgctgcccgcaattatgccggtcctggcgacggtggtgacactgcgcaccatctggatgttctacatgttcgcggatgtttatttgctgacgaccaaggtcgatattctcggtgtatatctctacaaaaccgcctttgcctttaatgatttaggaaaagcggcggcgatctcggtggtgctcttcatcattattttcgctgtcattctgctgaccaggaaacgggtgaacctcaatggcaacaaataaacgcacactcagtcgcatcggtttttactgcgggctggcgctgtttctcatcatcacgctgtttccattttttgtgatgctgatgacctcgttcaagggcgcgaaagaggcgatctcactgcatcctacgctgctgccgcagcagtggacgctggagcattacgtcgacatttttaacccgatgattttcccgtttgtcgactacttccgtaacagtctggtggtgtctgtggtttcatccgtggtggcggtattcctcggcattcttggggcttacgcgctttcccgcctgcgctttaaaggtcggatgaccatcaacgccagcttttacacggtgtatatgttctctggcattttgctggtggtgccgcttttcaaaatcatcaccgcgcttggcatttacgacactgagatggcgctgatcatcaccatggtgacgcaaactctgcccaccgccgtgtttatgctgaaaagctacttcgacaccatccccgatgagatcgaagaagcggcgatgatggatggcctcaaccgtctgcaaattatcttccgcatcaccgtgccgttggcgatgtccgggctgatatccgtgttcgtctactgctttatggtggcgtggaacgactatctgtttgcgtcgattttcctctccagcgccagcaatttcaccttaccggtgggcctgaacgcgctgttcagtacgccagattacatctggggacggatgatggcggcctcactggtgaccgcattgccggtggtgattatgtatgcgctttcggaacgttttattaagagtggtttgaccgccggtggcgtgaagggctaaagcggccagtttctttacaaggagttttaaatgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaattcaaaggaatgaaaaaaatgaaaatcggcacacagaatcaggcgttctttccggaaaacattctggagaaatttcgttatatcaaagagatgggcttcgatggttttgagattgacggcaaactgctggttaacaacatcgaagaagtcaaagcggcgatcaaagaaaccggtttaccggtgaccaccgcctgcggtggctatgacggatggattggcgactttatcgaagagcgtcgtcttaatggcttaaagcagatcgagcgcattctcgaagcgctggcagaagtgggcggtaaaggcatcgtcgttccggctgcgtggggcatgtttaccttccgcttaccgccgatgacctcgccgcgtagcctggacggcgaccgcaaaatggtgagtgattccctgcgcgtactggaacaggtcgccgcgcgtaccggaaccgtggtgtatctcgaaccgttaaaccgctatcaggatcatatgatcaacaccctcgccgatgcccgccgttacatcgtcgaaaacgatcttaaacatgtacagattatcggcgatttctatcacatgaatatcgaagaagataacctggcgcaggcgctgcatgacaaccgcgacctgctcggtcatgtgcatattgcggataaccatcgctaccagccgggcagcggcaccctggatttccacgcgctgtttgaacagctgcgcgcggataactatcagggctatgtagtgtacgaagggcgtatccgggcggaagatcctgcccaggcgtaccgtgattcgttggcctggttgcgtacctgctaagaggtctttgtgaaaagtgcaatgacaagctctccgctgcgggtcgcgataataggcgcaggccaggtggcggataaggttcatgcttcgtactactgcacccgcaacgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcactggaagcgggctgccatgtgatgtgcgaaaaaccgcccgccatgacgccagaacaggcgcgggaaatgtgcgataccgcgcgcaaactgggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgctgcgatgtatgtgctgggctttccggcggtgaaaagcgtgaatgcgcatagctttcaaaagatcggcacgcaaaagagctgtggtcaatttggtgagtgggatccggcaacttacagcgtcgaagattcgctgtttggcaccattgaatttcataacggcggcattctgtggctggaaacgtcatttgcactcaacatccgcgaacagtcgattatgaacgtcagcttttgtggtgataaagctggtgcgacgctgtttccagcacatatctacaccgataacaacggtgaattaatgacgctgatgcaacgggaaatagcagacgacaaccgccatttgcgcagcatggaagcctttatcaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcataccctgaacaagtatgcatcgctgatggcgcaggggaacggctatcttgggcttcgcgccagccatgaagaagattacacgcgccagacgcgagggatgtatctggcggggctgtatcatcgggcgggaaaaggtgaaatcaacgaactggtgaacctgcctgatgtcgtggggatggagattgccataaatggtgaggttttctcgttatcccacgaagcctggcagcgtgagcttgactttgccagtggcgaattacgccgcaatgttgtctggcgtaccagcaacggctcaggttacaccatcgccagccgtcgctttgtttcggcagaccaactgccgctcattgcgctggaaatcactattacgccactggacgccgacgcgtcagtgctgatttcaacaggcattgacgccacgcaaaccaatcacggtcgccaacatctcgacgaaacccaggtgcgggtgtttggtcagcatctgatgcaggggagctacaccacccaggatggacgcagtgatgtggccatcagctgttgctgtaaggtgagcggtgatgtgcagcaatgctataccgccaaagagcgccgtttactgcaacataccagtgcgcagcttcatgcaggcgagacaatgacgttgcaaaaactggtgtggatcgactggcgggatgacaggcaagctgctttagacgagtggggcagcgcgtcgcttcgccagcttgaaatgtgcgcgcagcagagttacgaccaacttcttgcagcatcaacagaaaactggcgtcaatggtggcagaaacgtcgtatcacggtaaatggcggcgaagcgcacgatcagcaagcgttagattatgcgctttatcatctgcgcatcatgacgcctgcccacgacgagcgcagcagcattgcggcaaaaggcttaaccggcgaaggctacaaaggccacgttttctgggatacagaagtatttttgttaccgtttcatctgtttagcgatccgacggttgcccgaagtttactgcgttatcgctggcacaacttgccaggcgcgcaggagaaagcgcgacgcaacggctggcagggcgcgctatttccgtgggaaagcgcgcgcagcggcgaagaagagacgccggaatttgccgccattaacattcgcaccgggctgcggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccagaaattcagcccgacggcgttttgccgcaggatgattcgtttatggctaagccggcgattaatctggcgaaatacaaagcggcggcggggaagcaaaccatactgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccgcatagttgtgatgatggtatccatgctgccgcaactggcgctatctggctgggggcgattcagggttttgccggggtgagcgtgcgtgacggtgaattgcatctcaatccggcgttacctgagcagtggcaacagttgtctttccctctgttctggcagggctgcgaattacaggtcactcttgacgcgcagcgtattgcgattcgaacttctgcgcccgtttcactgcgtttgaacggtcagcttataaccgtggctgaagaatctgttttctgtttgggtgattttattttgcccttcaatgggaccgctaccaaacatcaggaggatgaatgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatagcaaaggaatcaacatggctcagctttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttggtctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttgggggcacgagttagtggtccgtgctggtgcgttaaatgattatcatgcaggagaaaatatcactattcattttgatatgacgaaatgtcatttctttgatgcagaaacggaaatagcaatt

SEQ ID NO: 35 - protein, 381 aa, Artificial Sequence [sequence omitted]

SEQ ID NO: 36 - DNA, 10160 bp, Artificial Sequence
  Description of Artificial Sequence; note = synthetic construct
ttactcacaacttattgaatctgcatgatattgcctgccgggtaaggcgttacgccgcatccggcatcaaatgactcaacgttgtcccgcttctggtttgcgcgatttttgccagtaaaaatgctcgcgcaaaccttccgccgactcttccgccacagcacgcaattcatcgctgtccgcttcatgacgcagctgatgatccacattctttacccacacaaattcatgtcctttgtgccctgccatgagttgtcctgaaaacagagcacacgttaataagacaaccgataacgccttcgtaaacatcctgccacctttttcttaccttttgccgctatgatgccgatcgtttcttgaggttattattcagttttgcaaattagcgcaaagaaattctggaatcttccttcctgattttgcattgcattctgccgttgcggcgatttagtgctattttcgagcaaattacacacggaggtaaacactaatgtttactttgttgatatactcagcggcagggaggcgatgtgaaacaaagcgagttcagacgttggctcgaatctcagggcgtcgatgtagcgaatggcagcaaccatttgaaactcaggtttcatgggaggcgcagtgtcatgccgcgtcacccctgcgatgagattaaagaaccattgcgtaaagcaatcctgaaacaactcggtttgagttaatcgccaattaaaaaggttaatgacatgcgagagacagtcgaaattatgcgttatcccgtcactcttacacccgcgccggaaggcggttatatggtttcttttgtggatatccctgaagcgttgacccagggcgaaactgtcgctgaagcgatggaagcggcaaaagatgctttactgaccgcatttgatttttattttgaagataacgagcttatccctttaccttcgccattaaatagtcacgatcactttattgaagtacctttgagcgtcgcctctaaggtattgctgttaaatgcttttttacagtcagaaatcactcagcaagagttagccaggcgaattggcaaacctaaacaggagattactcgcctatttaacttgcatcatgcgacaaaaatcgacgccgtccagctcgcggcaaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttcaggcatgagctttatgactgtcagccatgcctatcagttgctcgaaagtcagggatatattatcgcacgaccgcagtcgggttattacgttgcgccacaggcaataaaaatgccgaaagcgccagtcattccagtcactcgagatgaagcagtcgatatcaacacttatatttttgatatgttgcaggccagtcgcgatccgtcggtcgttccgtttgcctcggcctttcccgacccgcgacttttccccctccaacaactaaaccgctcgctggcgcaggtaagcaaaaccgccacagcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagcggtaactgaaccgggcgattgggtgatagtagagaatccttgtttctacggtgcgttgcaggcgctggagcggctacggctgaaggcgttatcggtggcgacggatgttaaagaagggatagatcttcaggcgctggaactggcgttgcaggagtatccggtgaaagcgtgctggctgatgactaatagccagaatccactcggatttaccttaacgccgcaaaaaaaagcacaactggtggcgttgctcaatcagtacaacgtaacgctgattgaagatgacgtttacagcgaactttattttggacgggaaaaaccgctgcctgcgaaagcgtgggatcgccacgatggcgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcaacttgcgctggtggattacctttccacgcgccgatacgacgcccatcttcgtcgcctgcgtcgccagcttgcggaacgtaaacaacgtgcctggcaggcactgctgcgttatctgcctgcggaagtgaaaattcatcataatgacagtggttactttctctggttggagctccccgagccgttagatgccggcgaattaagcctggcggcactgacgcatcatatcagtattgcgccgggtaaaatgttttctaccggtgaaaactggtcacgttttttccgttttaataccgcgtggcagtggggagagcgtgaagaacaggcggtaaaacaattaggcaaacttattcaagaacggctgtaatagcgtttaatttaattcctcttagattgggtaatatgaatttcgaatagcagtcatatttcctaactccttgactatactccagaagataaccttacagacggcataatgcgcggtagctcacaacctgaataaattttctcaggggcgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagataaaccggaagggcgactggatattatcgcctggccgggatacatcgaacgcggacaaactgataaacaatacgactgggtaacgcagttcgaaaaagagacaggctgcgcggtgaatgtgaaaaccgccgcgacttccgatgaaatggtcagtctgatgaccaaagggggttacgatctggttacggcatccggcgatgcctcgctgcgtttgattatgggtaaacgcgtgcagccgattaataccgcattgattcccaactggaaaacgctcgatccgcgcgtggttaaaggcgactggtttaatgttggcggcaaagtttacggcacaccttaccaatgggggccgaacctgctgatgtacaacactaaaaccttcccgacgccgccggatagctggcaagtggtttttgttgagcaaaatctgccggacggcaagagcaataaaggccgcgttcaggcttatgatggccctatctatattgcggacgctgcgttgttcgttaaagccactcagccgcagttgggcatcagcgatccgtatcaactcaccgaagaacagtaccaggcggtgctgaaagtgctgcgcgctcaacacagtttgatccatcgctactggcatgacactaccgtgcaaatgagcgatttcaaaaacgagggtgtggttgcttccagtgcctggccctatcaggccaacgccctgaaagccgaaggccagcctgttgctaccgttttcccgaaggagggtgttaccggttgggctgataccaccatgctgcatagcgaagcgaaacatccggtttgcgcctacaaatggatgaactggtcattaacgccaaaagtgcagggcgatgtggcggcctggtttggctcgttaccggtagtgccggaagggtgtaaagccagtccgttattaggcgaaaaaggttgtgaaaccaacggttttaactatttcgacaaaatcgccttctggaaaacgcctatagcagaagggggcaagtttgttccctacagtcgctggacgcaggattacattgccattatgggcggtcgctaacttcgctggggtgctttatgacgtacgcagtggagtttgacaacgtctcgcggttgtacggtgacgtgcgcgcagtagatggcgtcagtattgcgataaaagatggtgagttcttctctatgctggggccgtccggctccggcaaaaccacctgcctgcgcctgattgctggcttcgaacagctttccggcggggctatctctatctttggtaaacccgccagcaatctgccaccgtgggagcgggacgtgaatactgtctttcaggactacgcgctatttccgcatatgtcgattcttgacaatgtcgcctatgggctgatggtcaaaggcgtgaataaaaagcagcggcacgcaatggcgcaagaggcgctggagaaagtggcgttggggtttgtacatcaacgtaaaccgtcacaactttctggtggtcagcgccagcgggttgctatcgccagagcattggtgaatgaaccgcgcgtattgctgttggatgaaccgctcggcgcactggatctcaaattgcgtgagcagatgcagctggaactgaaaaaactgcaacagtctctcggtatcacttttatcttcgttacccacgatcagggcgaagcgttatcgatgtccgatcgtgtggcggttttcaataatggacgcattgagcaggtcgattccccgcgcgatctctatatgcgcccgcgcacgccgtttgttgccgggttcgttggtacatcgaatgtttttgatggactgatggcagagaaactttgtggcatgacgggaagcttcgccctgcgaccggaacatatccgcctcaacacccctggtgaactgcaggccaatggcacgatccaggcggtgcaatatcagggcgcggcaactcgttttgaactgaaattgaacggcggtgaaaaactgcttgtgagtcaggccaatatgacaggcgaagaactgcctgccacgctcacgcccggacaacaggtgatggtttcctggtcgcgtgatgtgatggtgccgctggttgaggagaggtgaatggcgatgaatgtattgcaatcaccttcacgtccaggtctgggtaaggtgtccggtttcttctggcataatccggggctggggctgtttttactgctgcttggcccgctaatgtggtttggcattgtctatttcggctcgctgctgacactgttatggcagggattttatacttttgacgatttcaccatgtcggtaacgccggaactgacgctggcgaatatccgtgcgctgtttaatccggcgaattacgacatcattctccgcacgctgactatggctgtggcagtcactatcgccagcgccattctggcttttccaatggcgtggtatatggcgcgctataccagcgggaaaatgaaagcgtttttttatattgcggtaatgttgccgatgtgggcgagctacattgttaaagcctatgcctggacgttattgctggcaaaagatggcgtggctcagtggtttttacaacatcttgggctggaaccactgctgactgcgttccttacattacctgcggtgggcggaaatacgctgtcaacttccgggctggggcgctttctggtgtttctctatatctggttgccgttcatgatcctgcccgttcaggcggcgcttgagcgtttgccgccgtcattgttgcaggcgtcggctgatctcggcgcacgtccacgacaaacctttcgctatgtggtgctgccgctggcaatcccgggtattgccgctggctctatctttaccttctcactcacactgggcgattttatcgtcccgcagctggttggtcctccaggatattttatcggcaatatggtttattcccagcagggggcgattggcaatatgccgatggcggcggcattcaccctggtgccgattattctcatcgcactgtacctggcgttcgtgaaacgtctgggagcgttcgatgcactctgaacgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgatgccgtgacactgtcacttaaagtggcggcgctggcgacattaattgcgctggtgttagggacgctggcagctgccgcgctgtggcgacgagactttttcggcaaaaacgccatttcgctgttactgctgctgcccattgcgctgccgggcattgtcactggtctggcgttattaaccgcctttaaaaccatcaatctggagccgggatttttcaccatcgtggtcggtcatgcgactttttgtgtagttgtggtgtttaacaatgtcatcgcccgttttcgccgcacctcctggagtctggttgaggcgtcaatggatcttggggccaatggctggcaaaccttccgctacgtagtgttgccgaatctcagttcggcgttactggcaggaggaatgctggcgtttgccttgtcgttcgatgaaatcatcgttacgacctttacggcaggtcatgaacgaacgttaccgttgtggttgctcaatcagcttgggcgaccgcgtgatgtaccggtaactaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgccaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccagatgacgagtctacggagcttggacctttaagctcgctggcgcatctcgaacgcgtcggcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgcccttcgacaacgaagaacaggtggtgaactgggcgaatgacagccagtacggacttgcatcttcggtatggacgaaagatgtgggcagggcgcatcgcgtcagcgcacggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagaaatttatcagtactacagttctactggaaacattcatttttgccaccttttatcattgcccctatgtgtatagtacgggttaagaaaatccgcaataatactcattctgaagatggataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttcactgttttaaatcttactcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcaacgtctgcgcacagcgatcgcccatcacggtcgcaagcataaagaagatatggaagcgcgccacgaacagttaaccaaaggcggcaccatcctctgattaaaatgagcgtctggctaccaaccaggcgccaaccacaagtaaaattgcgccacaaattgggccgaacaacgcccgtagtggtacgccatgactgcggaagatatccagcatcagaccgccaatcagctgactggcgaccagtacagcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggacaaccagaccaattccggcggcaatcaaaaaagcaagggtgagcgactgattcatccaatcgcgtccggttcagtgcgctcgtcgagttgcaactgcataaatgtcagatccagccaacgaccaaatttagtgcctacctgcggcatttgcgcggtgacgacaaatcccagcgactggtggagatgcagcgaggcctgattttgcgattcgatcccggcgaccatgacatgcttcccgcaatcccgcgcttcatcaatcaatcggcttaacaatttacgccccagacctttgccctgatgatcgggatggacataaaccgaatgttccacggtatggcgaaaaccatcgaaactacgccagtcgccaaacgaggcatatcccgtcactacgccgttttcctcgctcaccagcactggataacctgctaaagtccgcgcttcaaaccaggcaatgcggttatcagcatccaccgtttggtcattccagatagccgccgtatacaacacggcgtggttataaatttccgcaatggcagcacagtcggctttgcgggcaaaacggatggacatgtctggcctcaataaaataatgatgatgatgttatcaatactatcgaaaacagcccgaagcaacggattcct

SEQ ID NO: 37 - protein, 516 aa, Artificial Sequence
  Description of Artificial Sequence; note = synthetic construct
MKRSISFRPTLLALVLATNFPVAHAAVPKDMLVIGKAADPQTLDPAVTIDNNDWTVTYPSYQRLVQYKTDGDKGSTDVEGDLASSWKASDDQKEWTFTLKDNAKFADGTPVTAEAVKLSFERLLKIGQGPAEAFPKDLKIDAPDEHTVKFTLSQPFAPFLYTLANDGASIINPAVLKEHAADDARGFLAQNTAGSGPFMLKSWQKGQQLVLVPNPHYPGNKPNFKRVSVKIIGESASRRLQLSRGDIDIADALPVDQLNALKQENKVNVAEYPSLRVTYLYLNNSKAPLNQADLRRAISWSTDYQGMVNGILSGNGKQMRGPIPEGMWGYDATAMQYNHDETKAKAEWDKVTSKPTSLTFLYSDNDPNWEPIALATQSSLNKLGIIVKLEKLANATMRDRVGKGDYDIAIGNWSPDFADPYMFMNYWFESDKKGLPGNRSFYENSEVDKLLRNALATTDQTQRTRDYQQAQKIVIDDAAYVYLFQKNYQLAMNKEVKGFVFNPMLEQVFNINTMSK

SEQ ID NO: 38 - DNA, 10437 bp, Artificial Sequence
  Description of Artificial Sequence; note = synthetic construct
ccatttcatgttggagagtgtgcgatgctgcgacccgaacatggcagtcgcagcaaaggcctcttagtgacggaaatcaatcaccatgcggccacggattttgccttcttccatctcagtaaagatggtgttgatgtccgctaacggacgcagggcgactttcggcaccactttaccttcggcggcaaactggaaggcttcagttaaatcctggcgcgtgccgaccagcgaaccgaccacttcaataccatccagcacaagacgtgggatatccaggctcatagactccggcggtagaccgacagccacaacacgaccgcctgcacggacagcatcaactgccgagttaaacgcagctttagctaccgctgttaccaccgcagcgtgagcgccaccagttttctcctgcacaattttggcggcgtcttcggtgtgtgagttaatcgctaaatctgcgcccatttcggttgccagttttaactgctcatcattgacatcaatggcgatcactttggcgttaaagacattcttcgcgtattgcagggcgaggttacccagaccgccaagaccgtagatagcaatccactgccctggacgaatttttgacagcttaacggctttgtaggtggtgactcccgcacaggtaatgctgctggccgccgccgagtccagaccatctggcacttttaccgcgtaatcggcgaccacgatgcactcttccgccatcccgccatcaacgctgtatccggcatttttaactgaacggcagagcgtttcgttaccactgttacagtattcgcaatgaccgcatccttcgtagaaccacgccacgctggcacgatcgcctggttttaatgaggtgacacctggacccacttctgccaccacaccgatgccttcatggcccagaattacgccggttttgtcaccaaaatcgccattcttaacatgaagatcggtatgacatacaccacaacactccattttcagcagggcttcgccatgtttcagtgagcgcagtgttttatacgtaacgtcaacatgatgatccttcgtaacaactgcagccttcatagttcctccttttcggatgatgttctgcatagcaggtgaggcaaatgagatttattcgccactacccagtatggatgagatctgaaaaagggagagggaaatagcccggtagccttcactaccgggcgcaggcttagatggaggtacggcggtagtcgcggtattcggcttgccagaaattatcgtcaatggcctgttgcagggcttcggcagaggttttcaccgccacgccttgctgctgcgccattttgccaaccgcaaacgcaattgcgcgggagactttctgaatatctttcagttccggcagtaccataccttcgccgttcagcaccaatggtgaatactgcgccagcgtttcacttgccgacatcagcatctcatcggtgatacgtgacgcgccggaagcaataacacccaggccgatgcccgggaaaataaaggcgttgttacactgggcgatagggtagattttatctttccataccactggattaaacgggctgcccgtggcgaccagcgcgttaccttcggtccaggcgataatgtcctgcggtgtggcttccacgcgtgacgtcgggttagacagcggcatcacgatcggacgcggacagtgtttatgcatctcacggatgatctcttccgtaaacagcccggtctgtcctgagacgccaatcagaatatctggttttacattgcgcaccacatccagcagtgacagcacatcgctgtcggtatcccagtcactgaggttttcgcgcttctgcaccagtttggtctggaaaggcagcaggttcggcatcttgtcagtcagcaagccaaagcgatcgaccataaagactttctgccgcgccgcttcctcgcttaatccttcgcgctgggtctgggagatgatcatttcggcaatgccgcatcccgctgaacctgcgccaaggaagacgatttttttctcgcttaactgaccacctgccgcgcggcttgctgcgatcagtgtgccgactgttaccgccgcagtgccctgaatgtcatcgttaaaagaacaaatttcattgcgatagcggttaagtaacggcatcgcatttttttgagcaaagtcttcaaactgcaacagcacgtctggccagcgttgtttcacagcctggataaattcatcaacgaattcatagtattcgtcgtcagtgatacgcggattacgccagcccatatacagcggatcgttaagcagctgttggttgttcgttccgacatccagcaccaccggaagggtatacgccgggctgatgccgccacaggcggtatagagcgacagtttaccgatcggaatgcccatcccgccgatgccctggtcaccaagccccagaatgcgttcaccgtcagtcaccacaatcactttaatattatggttcggcacgttttgcagaatatcgtccatattgtgccggttctggtaagagataaacacgccgcgtgaacggcggtagatctcagaaaaacgctcacaggctgcgccgacggttggggtataaataacaggcatcatctcatcaagatgattgtttaccagacggtagaagagggtttcgttagtgtcctggatgttacgcaggtagatgtgtttgtcgatttcggttttgaatccctgatactggatccatgctcgttccgcttgttcttcgatggtttcgaccacttccggcagtaaccccagcaggttgaagttacggcgttcttccatgctgaaggcactgcctttattcaacaacggaaattccagcagtacagggccagcgtaagggatataaagcgaacgctgtttttttgtttttggttccatgtcactcactcttttttgaatatccatccctggggggcttttatcgtctttgctttaccgccagggcgtcggcctcaagtataaagcagataaaaacaaaaacaccattgcgcaggcaatggtgtttaatcgtcattgaggactgatggttatgaattacttttcagcggggcgttttctgccggttgggttatttactacgctggatttgtcaccttcggtaactattttgcgctggttagaaattttatggtccagtccaagaatatgacgtgcctgacggttcgatttcattttaactcctcaatcctgtagctagttttaaggacaacatcgccgtagcgaagaaacacgtgctaaacccctaaattaggttgccgatcaagcatagcaccttaaagcgtagggtgctggccactgaccacataattgatcgtttgctggtagatatcactgaggatgtcgttatcagaagcttcaacccatttggtcagctccatgagaatgtcatcttcagtgacaacaccatgctgtgcccgaaggccttgctcaatggcattaaccagagcgggttctgctgttgaattttctgcctgataataagtaaacatagtgattctccgtgtctgtgtatttatggtgtctgctacggatcgcagatttataaagcacattcagcatggcaaatatttgccgcttcgttgttaagattagtcctggttgatgatttttatattttaacaccatgatattcatagggattgtgattggtatgatccgattaatattgatacaatatcttttgggttatatattcccggtaatctattgtgggaatttaatttaagtgcagaagtaatattttcgccggattttattcggaatatcctgcttatcctcgtgctgtttctcacgtagtctataatttcctttttaagcccacaggagagcaacaatgacaatccataagaaaggtcaggcacactgggaaggcgatatcaaacgcgggaagggaacagtatccaccgagagtggcgtgctgaaccaacagccgtatggatttaacacgcgttttgaaggcgaaaaaggaaccaaccctgaagaactgattggcgcagcgcatgccgcatgtttctcaatggcgctttcattaatgctgggggaagcgggattcacgccaacatcgattgataccaccgccgatgtgtcgctggataaagtggatgccggttttgcgattacgaaaatcgcactgaagagtgaagttgcggtgccgggtattgatgcctctacctttgacggcataatccagaaagcaaaagcaggatgcccggtctctcaggtactgaaagcggaaattacgctggattaccagttgaaatcgtaaagcattgccggatgacgcgtcaggcgcgtgaatgcctgatgcgttgttagcatctctacagcgcccgccagcaccggagctcacgtccgtcctcccttattgctaatgattgccggacttcacatccgtgggttgccagcgggcaacgttcgtagaaaaaacagccttgcggcaacgtgcggtttcccggcagatccgttttacgtaatgcccattcttcctccagcggtttatcaatggcggggagggaatccagcaataatcgggtgtatggatgtgcaggtgccgtcagcacctgctgcgcgtcgcccagttctacaatctgcccgagatacatcaccgccacccgatcgctcatatgacgtatcaccgagacattgtgtgaaatcagcacataggtcagcccgtgattttcctgtagcgttaccagtaaattgaggatctgcgcctgaacggagatatccagcgcagaggttggctcatcaagcacaatcacgtcaggctgcgaagagagtgctctggcaatggcgatacgttgccgctgcccgccggagaacgcatgaggcaggcggtcgagatactccggacgaatacccacctgcacagccaactcctctgccaacgctcgccgctgttgttcactactacgcttagctatccagagcggttctgtgatgatgcgccacaccggtaagcgcggattaagcgaagagagcgggtcctgaaacaccatctgcataatgcgttgtgagccagaacggatgtactgcccgtggctcggttgcagcatacccattaaaagctgtgcgagggtgcttttgccgcagcctgactcgccgacgatccctaaggtttcaccacggcggatctgtaaatcaataccattaatggcatgaacatgttccgtagttttaccaagccagtttttacgggccgggaaattgatatggacgtcgcgtaacgttaataacgtgtcagacacttataacctcctgctgcggataccaacaggcacagcgctggttgttgtcaccacacgctgtcagcgccgggacgttttcacactgtgcacctgccgcatagcaacgatcgcgaaaagcgcagccgtcaggcaaatgggtgaggtttggtaccgtccctggaatggcgggtaatagctggcgtggtactccatgttctggtgcgcattgcagcaaaccaatggtatacggatgccggggatgatggataacgtctgccgtcacgccgctttcaattacgcttccggcatacatcacgtaaacgctatcgcacagttgcgacaccacggccatatcatggctgatgaacagaaccgcagttccactggcgcgggctttatgtttaagcaaacgcagtacctgcaactgcaccgtgacgtccagcgccgtagtcggttcgtcggcaataatcaattgcggctcgcaggagaatgccagcgcaatcattacccgctggcgcataccacctgaaagctcaaacggatagcgcgacataacttccacggcatccgggatttgcatctcttccagcaggtcaatcgctttagctctggcttcccgacgacttattggttgatgatggcggatcacgtccatcatctgaagacctattcgacgtgtcggattgagggcggtcatcggttcctgaaagatcatcgccactcgtgcgccgcgccactgacgaagctgtttttcccgcgcgttaagaacatcttctcccagcagggaaatctgcccccgatgtacgcaataactgcccgtcggtagcagacgcataatcagcattgcggtgactgatttacctgagccggattctcccaccagaccgacaatttcaccgcggttaatctgcaaggacacattgttgagcgcgtgaacatcaccgttaaaaccggggaaactcaaatgcagttgttgaatgtccagaacgggttgggtcatgactgctttcctcctgctttcgggtcaagcagatcgcgaataccatcaccaaagagattaaacccgacggcggtaagcaaaatcgctgcccccggaaatgcgcaataccaccactgatcgagtacatagttgcgaccatttgctaccatcgcgccccattcagcactcggttgttgagcacccaggccaataaatcccaacgtggcggccattaaaatcgcgctaccgatatccagcgatgcctgcacgatcagcggcggtagggagttacgtaaaatatgccagttgatcagatgccaacgagacgcgccaaaggttttcgccgcctgaacataggtatactggcgtacaactaatgcttgcccccgcgccaggcgcacataaaagggaattcgcacaatagcaatagccagcatggcgttaaacaaactcggcccgagagcggcagccagtgccattgtcagtaccaacgaaggaatcgacagcataatgtccatgatgcgcatgatgatggcgtctgcgcgtccaccaagcacaccggatagacatccgagtagcgaaccaatcatacccgcaatggcaaccacgactaatccggcgagaattgattgctgactgccgaccagtacgcggctaaacagatcgcgtcccacttcatcggtgccaaaccagtgcgccgcagaaggcggcaaaaggcgggcggttaaatcaatggcgttgggatcatgcgtcgccagccacggtgaaaaaatcatcatcaatagcattaatacaatgatgactgcgctggtcacggtgagcggactgcctttcagcatccataccagttttgcaccgttaaatcgcgtttgtttttgtgggcgtacggcggacgtttcctcgcttagcatcattcaccacctccacgtccgatacgcggatcaatccacaaatagagcaaatccaccaccaggttgaccagcacataagcaaatgaaaccacgacggcaaagcccatcactgccgggaagtcgagcgcctgtattgatgttactacccatgcacccattccgggccaggcaaaaacggtttcggtgagcactgcgccatacaacaaatcgcccagcgccaaacccaatacggtaatcgatgggatcaacgcattgggtagcgcataacataaaacgatataccagccgggcaagccgctggcccgggcggtacgaatgtagtcttcactcaattgttccagcatcgctgagcggatctggcgagcgacaattcccaggtgaacgaacgccagcgttaatgccggtaagatgagatgttgcaacgcattgaagaagacttcaccgttgccttcaagcagcgcatcgagcagataaaagccggtaacgtgcgttggtggatccagccagtcatcaagccttccgccgccgggaagaatttgcagatgaccataaaacagcacaatgacgcccagcccaagccagaacgcaggtgtggagattccggtaatggccattattcgcaccagatgatccagccagcgatttcgccagactgcagagagtatgcccagcgggatgccaatcaggagtgccagcagcagggcaccaaaagccagctccagcgtcgccgggaaaaatatacgcaactcttccagcaccggacgcccggtacgaatggatgttcccaggtcaccatgaaacaggtcgctgacgtagcggtaaaactgtacatacagtggctggtccagtcccagttgctggcgaatattttccacgatagcatcgctggcgcggtcacccgccagtaaccgcgccggatcaccagggatcagatgcgagataataaacgtaatcacgcagacgcccgccaccacgagcaccagcccccagcagcgttggcgtaaaatactccagaaggtcacgttatttactcatggtattgatattgaagacctgttccagcatgggattgaacacaaagcctttcacctctttgttcatcgccagttggtagtttttctggaacaggtacacataagcagcgtcatcaatgacgattttctgtgcctgctggtagtcccgggtacgctgcgtctggtcggtggtcgcaagcgcattgcgcagtaacttatcgacctcactgttttcatagaacgagcggttacccggcagaccttttttgtctgactcaaaccagtaattcataaacatatacgggtcggcaaaatccggactccagttgccaatcgcaatgtcgtaatcacctttacccactctgtcgcgcatggtggcgttcgccagcttttccagcttcacaatgatgcccagcttgttgagactggattgtgtcgccagagcaataggctcccagttcggatcgttatcggagtagagaaacgtcaggctggtgggtttgctcgtcactttatcccattcggctttggctttcgtttcgtcatggttgtattgcattgccgtcgcatcgtagccccacatgccttccggaatcgggccgcgcatctgttttccgttaccactcagaatgccgttaaccatgccctgataatcggtagaccaggaaatggcccgacgcagatccgcctgattaagaggcgctttgctgttattcagatacagataggtaacgcgcagtgacggatactctgccacattgactttattttcctgcttcagggcgttgagttgatccaccggcagcgcatcggcaatgtcaatgtcgccacgggagagctgcaggcgacgggaggcactttcaccaataatttttaccgatacccgtttgaagttcggtttattgcctgggtaatgcggatttggcaccagaactaattgctgacctttttgccagcttttcagcataaatggtccggaaccggcggtattttgcgcgaggaagccgcgagcatcatccgctgcatgttcctttaagaccgccggattgataatggatgcaccgtcattcgccagcgtgtagaggaacggtgcgaatggttggctaagggtaaacttcaccgtatgttcgtcgggagcatcaatctttaaatctttgggaaatgcttctgctggcccctggccgatttttagtagccgctcaaaagaaagttttactgcttcggcagtgacaggtgtgccatcggcaaatttagcattatctttcagggtgaacgtccactctttttgatcgtcagacgctttccagctacttgccagatcgccttcaacgtcggttgagcctttatcaccgtccgttttgtactgaaccagccgctgataagacgggtaggtcactgtccagtcgttattatctattgttaccgccgggtcgagggtttgtggatcggcggccttaccaatcaccagcatatcttttggtacggcggcgtgcgcaaccgggaaatttgtggcaaggacgagcgcgagcaatgtgggacgaaacgatatcgatctcttcatgacagtttcctgattaactgacgtgctgtgtgccaggggatataaaacaagagaattgatcagcgagcagagggtaactcgctgcctggggtaattcgaagtgccaccattcgctggagataccgacaaaaccgccaccagtcattatcgcattcagcaacagccgattgcgctgagcggcgggcgggacggaagggtgataggcatgggagcgctcgtgcatttcatcgaaccctgcgcccatatcgaggatgttcccgtgctcatcacgaagcgtcaggtcgatcgccgtgccacggctgtgattagaaccgaccgtcacatcaacaacatattgcgggtctgggcaggcttgccacaacatcgcctgtgcttgttgtgggcgatacgcatcgtaaatcaccagttgtaaccctgacagctgggcgatgctgatacttttcgccagcgcggtaatcgcatccttgtgtaacagacaacgcgcttgctgataaatagctttacctgtgatgttatcagcgcaggcgtatttcaattcgatctccagatcagggaagattacggctaaatcaaccagttcggtggtatccgacataaacggttcctgtataagacaaaaattgctgcgctttccgcttatgcagatctcatgccatgccgggataagcgccagaatgctggcttaaagttatattttttaacttttgatcaacatttgtg

SEQ ID NO: 39 - protein, 305 aa, Artificial Sequence
  Description of Artificial Sequence; note = synthetic construct
MPLLKLWAGSLVMLAAVSLPLQAASPVKVGSKIDTEGALLGNIILQVLESHGVPTVNKVQLGTTPVVRGAITSGELDIYPEYTGNGAFFFKDENDAAWKNAQQGYEKVKKLDSEHNKLIWLTPAPANNTWTIAVRQDVAEKNKLTSLADLSRYLQEGGTFKLAASAEFIERADALPAFEKAYGFKLGQDQLLSLAGGDTAVTIKAAAQQTSGVNAAMAYGTDGPVAALGLQTLSDPQGVQPIYAPAPVVRESVLREYPQMAQWLQPVFASLDAKTLQQLNASIAVEGLDAKKVAADYLKQKGWTK

SEQ ID NO: 40 - DNA, 10264 bp, Artificial Sequence
  Description of Artificial Sequence; note = synthetic construct
agaattcgtgagtacgatcactcaaaatcgcctggcaaaaataaaatcaccctatagatgcacaaaaaacgggcaaaactacctggttcgcaaaactgcgtctaaagttaaaccgggacctcgcgagcaagggtgagacgatggcgctttacacaattggtgaagtggcgttgctttgtgatattaatcctgtcacgttacgcgcgtggcagaggcgttacggattgctgaaaccgcaacggacagacggcggtcatcggctgttcaacgatgccgatattgaccggatccgcgagatcaaacgctggatcgacaacggcgtgcaggtcagcaaagttaaaatgctgctcagtaatgaaaatgttgatgtgcagaacggctggcgcgatcagcaagaaacattactgacttacctgcaaagcggcaatctacatagcctgcgaacgtggatcaaagagcgcggtcaggattaccccgcccagacactcaccacacatctgtttattcctctgcgccgacggcttcagtgccaacaaccgactctccaggcgctgctggcgatcctcgacggcgtactgatcaactacatcgccatttgtctggcttcggcacgtaaaaaacagggtaaagatgcgctggtggttggctggaatattcaggataccacccgtctgtggctggagggctggattgccagtcaacaaggatggcgcattgatgtcctcgcccactcgctcaatcaactacgccctgaactattcgaaggccgtacattgctggtgtggtgcggtgaaaatcgaacctccgcccaacagcagcaactcaccagttggcaagaacaaggccatgatattttcccactcggcatttaatgattcgttaacaaatgcgctttactgtacaatcctttcgttaacataaggagtgcattatgcgcatagctaaaattggggtcatcgccctgttcctgtttatggcgttaggcggaattggtggcgtcatgctcgcaggttatacctttattttgcgtgctggctaagcgcctgcaccagcctttcaaacaggcggtctgcgatgatcgccgccagtgccaccagtaacgccccctggatcacatacgcggtattaaatccgctaagcccgatgatgatgggcgtacccagcgtgctggcccctaccgttgaggcgatcgtcgccgtaccaatgttgataatcaccgaagttcgcacgcccgccagaatcaccggagccgccagcggtagctcgaccttacgcactcgctgaccacgactcattcccatacctttcgcaacttctgtcacgctggcatcaatcgctcccagcccggcaagtgtcgcctgcaggacgggcagcacaccgtaaaggatcaaggcgataatcgctggttgcagaccaaagccgatcaccggaacggcgatcgccagcactgcgacgggcggaaaagtctgtccaacggcggcaatagtttccaccagtgggcgaaattccgcgccccacgggcgagtgacagcaattccggcaccagtgccaatgatcaccgcaaacaaactcgaaattcccaccagccagaaatgagccagtgccagagctgcaaaactttcttgctgataaacgggtcgtggcagttgtgggaacaaggcagcaaacagcggctggctgtaaggcagccagaaaatcagcgccacaaacagagcaatgagccagaacagcggatcgcgcaacatcttcatacgcttacgcctccaccagcagatcctgaaaatgcagcgtgccgcaaggctggccctgcatgttcaccaccggcagcacctcgcatccccgcgcaacaaacagagagagcgcatcgcgtagcgtcatctcttctgccagtgcctcaccatctgctcgttcttcgcgacgcacgtaatccgccacactacgtaacgaaagcaggcgcacacccagttcactacgtccaaaaaactggcggacaaaatcattcgccggacgagtcagcatcgtcagcggattgccctgctgcactacttcaccgtgatccatcaataccagatgttctgccagccgtagcgcctcatcaatatcatgagtgaccagcacaatggtacgccccagcaaacggtgaatgcgcgtcatctcttgttgcaacgcgccgcgcgttaccgggtccagtgcgccaaaaggttcatccattagtaagacttgcggatcggcagccagtgcacgcgccactcccacacgttgctgctgaccaccggaaagctgatgcggataacgctcacgcaaatttgactccagccccagtagcgccattaattcgtcgatacgatcgtcaatccgcgcccgcgaccatttttgtaattgcggcacggtagcgatgttttgcgccacgctccagtgggggaacaggccaatagattgaatggcatagcccatccggcggcgcaactccagtactggcagcgagcgaatttcttctccggcaaagcggatctctccgctgtcatgctccaccaggcggttaatcattttcagggtggtggatttgccggagccagatgtgccaatcagcaccgaaaaactcccttcctgaaaattgagattgagatcgttaacggctttttgtgcgccgaacagtttgctgacatggctaaattcaatcattacgtttcaccttcagcagtgcgataagcaaatcgaacagcgcgtcggtaagcaccgccagaacaattaccgggatcacccccagcaacactaaatcaatggcgctgcttagcagcccctggaaaaccagcgcaccaaaaccgcctgcgccgattaacgccgcaatcaccgccatacctacagtttgcaccatcaccacccgcaggctgcgcagaaataccggtaacgccagcggtaactgaacatgcaggaaacgctgcgccccgctcatccccatcgctctggcgctttccagcacatcgcgcgggatctggttcaaaccgactaccacgccgcgcaccagcggcagcaaggcatagagcaccagcgcaatcagtgcgggtgtcattccggttcctgctatgccgagcgtccccagccacggaaaggccgtaaccagcgcggcaagcggcgcaatcaacaggccaaagagcgccaccgaaggcacggtctgaatcacattgagcagagaaaaaattgccccctgccgagcagtggaaaagtagcaccagatgcccaacggcacaccaatcactaacgcaggcagcaccgcaccaaacagcaacgtcagatgttgtgccagcgcgtcgtcaaacacatcctgacggttggcgtattctttcattagtgagagatcgttaagcgtgccggagtacagcaaccacagcggaataatggcaatctgcatatgcaacaaccagcgccacagcggatgcgtggagattcggcggatggcatcgctacaggccagcaatgccagcgccgcagccagccagaaaccactgccgaggctggtacgcgccagcgcactgccattttgcgccagttgggtcgccgcctttccagctccccacaccagcaatacgaagacgaattgcgccagaatgagtgcacaaatgctgccttttttaccgggaataaaacaggccgtcagccaggcgcaaccaacgcccaccagcatccagatcgtttgcggccacagctgccagagatgacgcccctcacccgaaactaaacgattaggcgcgtaactgataaacggcagcgccgctgcgattgccgtcagcaacagcagcagcgccagaacaggattaatacggaaataagtcacgggaaattacttcgtccaccctttttgtttcaggtagtcggcagccacttttttggcatccagtccttccacagcaatgctggcattcagttgctgcaatgtttttgcatcgaggctggcgaagactggctgtagccactgtgccatttgcggatactccctcaacacggactcacgcaccactggtgcaggcgcgtagataggttgcacaccttgcggatcgcttaaggtttgcagccccagcgccgctaccgggccgtcagtgccgtaagccattgcagcattaacgccagaggtttgctgggcagcggctttgatcgtcaccgccgtgtcgccaccagccagtgacagcaactgatcctgaccgagcttaaagccataggctttttcaaacgcgggtaacgcatcggcgcgttcgataaactctgccgaggctgccagtttgaaggtgccgccctcttgcagataacgactcaggtcggcaagcgaagtgagtttatttttctctgccacatcctgacgcacggcgatagtccaggtgttatttgcaggcgcgggcgtcagccagattaacttgttgtgctccgaatcgagctttttgactttctcgtaaccttgctgcgcgtttttccacgctgcatcgttttcatctttaaagaagaaagcgccattgccggtatattccggatagatatccagttcaccggaagtaatcgccccgcgcaccacaggagtcgttccgagttgcactttattcaccgtcggtacgccgtggctttccagcacctgcaaaatgatattgccgagtagcgcaccttcggtatcgatttttgaaccgactttaacgggggaagccgcctgtagcggcaggctcacggctgccaacataaccagtgaacctgcccagagctttaagagtggcatgatgctttcctcattcttttactgttgttttcagcgaattaagagaaaagcatagttgataatggcggggttagcttgagcggaaggattcagttgcagaatcagataaatacttaagaggcatattcggtccggcgtttcctgccggatgcggcgcgagcgccttatccggcctacaaagggcgcaaacgtcgcgcccttactaaagcattacagcaactcaaactcgcctttcttaacgcgtgcggaatcagtgccgataaagacattgaacttgccaggctcggcgtcatatttcatctgttgattccagaacttcagcgcctcaatatcgatcgggaagctgacagtctgagtttcgcccggtttcagggtgattttctcaaagcctttcagctgtttcacagggcgactcatggaagccgtcacatcctgcaagtacatctgcactaccgtggcaccctcgcgcttaccggtgttcgtcacctgcacgctggcagtcactttgccgtcacgcttcatggtcggcgcagaaagtttcacatcagagacggtgaaagtggtgtagctcagcccatagccgaacggatacaacgccccgttagcttcatcaaaataacgcgaagtgtatttgttcggcttgtcggcattatacgggcgaccggtattcagatggctgtagtacaccgggatctgcccgacagaacgcgggaaggacattggcagcttgccggacgggttgtaatcgccaaacaatacatcggcaattgcattaccgccttcagtccccgcaaaccaggtttccagaatcgcatcagcctgctgatcttctttcaccagcgccagcggacgcccgttcatcagcaccagcaccagcggtttaccggtggctttcagcgccgcaatcaagtcacgttggctttgcggaatagtgatatcggtccggctggaggcttcgtgcgccatcccctgtgcttcaccgactacagccaccaccacatcagattgtttcgccgtctgcaccgcttcatcaatcatctcttgcggcgaacgcggatcgactttgaccgcttcttcatactgattcaggaaatcgataatgcctttgtcactggtaacgttcgcccctttggcatacagcactttaccgttttcaccgacggcatttttaatcccggtcagtacggtcacggattgatcggcaacaccggctgcggaccagctgcccatcacgtcacgtttactgtccgccagtggcccaaccaccgcaatggtggccgattttttcagcggtaacgtttcgagacggtttttcagcaacaccaagctttcgcgcgccacttcacgcgcttctttacggtgcaggcggctttcggcattggtatccaccgggtcagactctttcggccccaaatggctgtatgggtcgttaaacaaccccatatcatatttaacgttcagtacatggcgggcagcatcgtccagctctgccatcgtcactttgccggatttaatcaacccaggcagatacttcgagtagtactcgtcgctcatgctcatgttgattccggatttcagcgccacgcgcaccgcatcttccgggtctgccgccgtgccatgtttaatcagctctttgattgcaccgtgatcggaaacggtgatgcctttaaagccccactggtcgcgcagaacatctttcagcagccaggaatcggaggtggctggcgtgccgttcagcgagttcagcgccaccatcaccgcgccgctgcctgcgtccagccccgctttgtacggcggcatataatcattaaacaggcgctgcggactcatatcgacggtgttgtactctttaccgccttctaccgcgccgtatgcggcaaagtgtttgacgctggtcatcaccgagtagcgatctgccgggcttttaccctgcatcgcttccaccatggttttacccattgttgaggtgagatacgtatcttcgccaaaaccttcggaagcacgtccccagcgcggatcgcgcgagacatcgaccatcggtgcccaggtcatattcaggccatcatctgccgcttcataagcagagacacgtccgaccgttttcactgcatcgaggttaaaagacgaggccagaccgaggctaatcgggaacaccgtgcgctgaccgtgcagcacgtcgtaagcaaagaaaagaggaattttcaggcggcttaattccatcacctgatcctgcatggcgcggatatcctgacgggttacggtgttgaaaatcgccccaacctgaccgtctttgatcatctcgcggatcgcctctttcgggttatccgggccgacgctgattaagcgcagctgaccaattttctcatcaactgtcattttcttaagcagttcggtgacgaacgcatcccgcgcttcgggcgttaatggatggttgccgaataaatcatccgccagtgctggctgcagggccagactcaccgcgattcctactgaacatagccatttcatatggatttttcttcctttgttgcccgacgtggcagcgaaaatggtgcaaaaaccgtagtttgccataagcatgatggagagagaaaaagaatgctcagtttattgtctgaattttcaaaatattcactcgctgaattgttatacaaggcgctattctagtttgtgatattttttcgccaccacaaggagtggaaaatgtcttccatgacaacaactgataataaagcctttttgaatgaacttgctcgtctggtgggttcttcacacctgctcaccgatcccgcaaaaacggcccgctatcgcaagggcttccgttctggtcagggcgacgcgctggctgtcgttttccctggctcactactagaattgtggcgggtgctgaaagcctgcgtcaccgccgacaaaattattctgatgcaggccgccaatacaggcctgaccgaaggatcgacgccaaacggtaacgattatgatcgcgatgtcgttatcatcagcaccctgcgtctcgacaagctgcacgttcttggcaagggcgaacaggtgctggcctatccgggcaccacgctctattcgctggaaaaagccctcaaaccgctgggacgcgaaccgcactcagtgattggatcatcgtgtataggcgcatcggtcatcggcggtatttgtaacaactccggcggctcgctggtgcaacgtggcccggcgtataccgaaatgtcgttattcgcgcgtataaatgaagacggcaaactgacgctggtgaaccatctggggattgatctgggcgaaacgccggagcagatccttagcaagctggatgatgatcgcatcaaagatgacgatgtgcgtcacgatggtcgtcacgcccacgattatgactatgtccaccgcgttcgtgatattgaagccgacacgcccgcacgttataacgccgatcctgatcggttatttgaatcttctggttgcgccgggaagctggcggtctttgcagtacgtcttgataccttcgaagcggaaaaaaatcagcaggtgttttatatcggcaccaaccagccggaagtgctgaccgaaatccgccgtcatattctggctaacttcgaaaatctgccggttgccggggaatatatgcaccgggatatctacgatattgcggaaaaatacggcaaagacaccttcctgatgattgataagttaggcaccgacaagatgccgttcttctttaatctcaagggacgcaccgatgcgatgctggagaaagtgaaattcttccgtccgcattttactgaccgtgcgatgcaaaaattcggtcacctgttccccagccatttaccgccgcgcatgaaaaactggcgcgataaatacgagcatcatctgctgttaaaaatggcgggcgatggcgtgggcgaagccaaatcgtggctggtggattatttcaaacaggccgaaggcgatttctttgtctgtacgccggaggaaggcagcaaagcgtttttacaccgtttcgccgctgcgggcgcagcaattcgttatcaggcggtgcattccgatgaagtcgaagacattctggcgttggatatcgctctgcggcgtaacgacaccgagtggtatgagcatttaccgccggagatcgacagccagctggtgcacaagctctattacggccattttatgtgctatgtcttccatcaggattacatagtgaaaaaaggcgtggatgtgcatgcgttaaaagaacagatgctggaactgctacagcagcgcggcgcgcagtaccctgccgagcataacgtcggtcatttgtataaagcaccggagacgttgcagaagttctatcgcgagaacgatccgaccaacagcatgaatccggggatcggtaaaaccagtaaacggaaaaactggcaggaagtggagtaaaaattacggatggcagagtatcgccatccgaattcacttaatcgttctgtgccgtctgccccgccgccgccatttgggcggctttttgttttttatagctcaacgctgctgccggcacaggcatcactttaccggtttcaatccaggtacgcaggcggctggcatcggcaaaatgggtatatttgccaaacgcgtccatcactaccagcgccaccggtttattattgataaccgtacgcatcaccagacaatggcccgccgcattggtaaagccggttttggttaactgaatattccagttatcgcgatacaccagatgattagtattgcggaacggcagcgtatacgtcggattagagaaggttgccatatcttcccgggtagtacttaactgcccgatcaacggatattgtttgctggcaatgagcagtttggttaagtcacgggcagttgaaacgttatgcaccgacaatccggtaggttcaacaaagcgcgtgttgttcattccgagcgatttcgctttcgcattcattgccttaataaaggctttgtaaccaccgggataatggtgcgcaaggcttgccgccgcgcggttttctgaagacatcagcgccagcaacagcatatctttacggctgatttcgctattcagtcgtacgcgcgaatagacccctttcatctccggcgtctggctgatatccacttttagtttttcatccagcggcagtcgtgcatccagcacaaccatcgcggtcattaatttgctgatagacgcaatcggacgcaccagatccgggtggttcgaatagatcactttgttggtattcagatcaacaatcatcgcgctaccggaggcaatttccggttgtgaagcggtggtagcggctgccgttttcgcaacggcctgcggtgcaaaaggcacagccagcatcagggccaggctaaataaagaaactcgaaatttcggcatgatgagcattcagatagtggttcacgcgcacgggttgcgcaccgccggagtaaggatttactgaggctagcgacgccatcataacgagcaaaaagtgcgatcgtcaaaggagaatcgtg

SEQ ID NO: 41 - protein, 606 aa, Artificial Sequence
  Description of Artificial Sequence; note = synthetic construct
MQMIVRILLLFIALFTFGVQAQAIKESYAFAVLGEPRYAFNFNHFDYVNPAAPKGGQITLSALGTFDNFNRYALRGNPGARTEQLYDTLFTTSDDEPGSYYPLIAESARYADDYSWVEVAINPRARFHDGSPITARDVEFTFQKFMTEGVPQFRLVYKGTTVKAIAPLTVRIELAKPGKEDMLSLFSLPVFPEKYWKDHKLSDPLATPPLASGPYRVTSWKMGQNIVYSRVKDYWAANLPVNRGRWNFDTIRYDYYLDDNVAFEAFKAGAFDLRMENDAKNWATRYTGKNFDKKYIIKDEQKNESAQDTRWLAFNIQRPVFSDRRVREAITLAFDFEWMNKALFYNAWSRTNSYFQNTEYAARNYPDAAELVLLAPMKKDLPSEVFTQIYQPPVSKGDGYDRDNLLKADKLLNEAGWVLKGQQRVNATTGQPLSFELLLPASSNSQWVLPFQHSLQRLGINMDIRKVDNSQITNRMRSRDYDMMPRVWRAMPWPSSDLQISWSSEYINSTYNAPGVQSPVIDSLINQIIAAQGNKEKLLPLGRALDRVLTWNYYMLPMWYMAEDRLAWWDKFSQPAVRPIYSLGIDTWWYDVNKAAKLPSASKQGE

SEQ ID NO: 42 - DNA, 10691 bp, Artificial Sequence
  Description of Artificial Sequence; note = synthetic construct
caccttcgtccgctctccccttctcttttctgccttttttagccaggattaacgctcagttaacttaccagagtattgcggagccgttgtgaccaggaccaacctcatcaccggttttctcggcagcgggaaaaccacgtcgattcttcatctgttagcccataaagatcccaacgaaaaatgggcggtactggttaatgaatttggggaagtcggaattgatggtgctttgctcgccgatagcggcgcattgctgaaagagatccccggcggctgcatgtgctgcgttaatggtttacccatgcaggtagggttgaataccttactgcgtcagggaaaaccagaccgcttgttgatagagccgaccgggctgggccatccgaaacagatcctcgatctgttaaccgcaccagtctatgaaccgtggatagatctgcgcgccaccttgtgcattctcgatccgcgcttgctgctggacgaaaaaagcgccagcaatgaaaacttccgtgaccagctggctgccgcagacatcattgtcgccaataaatccgaccgtacgacgcccgaaagtgagcaagcgctacagcgttggtggcagcaaaatggtggcgatcgacaattaattcacagtgagcatgggaaagttgacggtcatcttctggatttgccgcgtcgcaatttagccgagttgcccgccagcgccgcgcattctcatcagcatgtcgtgaaaaaagggttagcagcgttaagcctgccagagcatcaacgctggcgtcgcagtctgaacagcgggcaaggatatcaggcctgcggctggatattcgacgctgatacggtattcgacaccattggcattctggaatgggcgcgacttgcaccggtggaacgcgtcaaaggcgtgctgcgtattcccgaagggctggtgcgaatcaaccgtcagggcgatgacctgcacattgaaacgcaaaacgttgcgccaccggacagccgtattgagctgatttccagcagcgaagctgactggaatgccttgcagagcgcgctgttgaagcttcgtttagcgactaccgcgtaaggttgcctgcgtttttcagtaagataattagagaaaatatgattaaaaatttgccgcaaatagtgttgttgaatattgtcggcctcgcgctgtttctttcctggtatatccccgttaatcatggattctggttgccgattgatgcggatattttttatttctttaatcagaaactggtcgaaagtaaggcctttttgtggctggttgcattgaccaacaatcgcgccttcgacggttgttcactgctggcgatgggtatgttgatgctgagtttctggctgaaagaaaacgcccctggcagacgacgtatcgtgattattggtctggtcatgctattaactgcagtggtattaaaccagctgggtcaggcattaattcctgtaaaacgggccagcccaacattgacttttaccgatattaaccgcgtcagcgaactgctctctgttcccacgaaagatgcctcacgagatagctttcccggcgatcacggcatgatgctgcttattttttcggcattcatgtggcgttatttcggcaaagttgcaggccttatcgcccttattatttttgtggtttttgcatttcccagagtaatgattggcgcacactggtttactgacatcattgtcggttcgatgaccgtgatattgatcggtttgccctgggtgttgctgacgccattaagtgatcgattaatcaccttttttgacaaatcactaccaggaaaaaacaaacatttccaaaacaaataactcacagtaattaacatcatcagggttatttttatagtgaggataatcctgatgatgcgcaccgtgctttcatctatcgaacgcaaaaatcattctctaagtaaatgaatggattgcatgcgtttcactcaattgtactttaattgaccaaccccgcttattaactttctgtatcactttttcttataaaaaatcatgtaaaaccgctcgccaagaccgcaccaatcgggtaatctcgaactcgttttgcctcggcggtagattatcctcacagcatataattttgtgcgttagtccacagatttggccttaaggaattgtttcaacatgcccaggtaattagtctcgtgtcgcttggcatttttttataacgatatttgtcgttaaggacttcaagggaaaacaaacaacatggtcaaatctcaaccgattttgagatatatcttgcgcgggattcccgcgattgcagtagcggttctgctttctgcatgtagtgcaaataacaccgcaaagaatatgcatcctgagacacgtgcagtgggtagtgaaacatcatcactgcaagcttctcaggatgaatttgaaaacctggttcgtaatgtcgacgtaaaatcgcgaattatggatcagtatgctgactggaaaggcgtacgttatcgtctgggcggcagcactaaaaaaggtatcgattgttctggtttcgtacagcgtacattccgtgagcaatttggcttagaacttccgcgttcgacttacgaacagcaggaaatgggtaaatctgtttcccgcagtaatttgcgtacgggtgatttagttctgttccgtgccggttcaacgggacgccatgtcggtatttatatcggcaacaatcagtttgtccatgcttccaccagcagtggtgttattatttccagcatgaatgaaccgtactggaagaagcgttacaacgaagcacgccgggttctcagccgcagctaataaaccgtttggatgcaatcccttggctatcctgacgagttaactgaaagcactgcttaggcagtgcttttttgttttcattcatcagagaaaatgatgtttccgcgtcttgatccaggctatagtccggtcattgttatcttttaaatgttgtcgtaatttcaggaaattaacggaatcatgttcatacgcgctcccaattttggacgtaagctcctgcttacctgcattgttgcaggcgtaatgattgcgatactggtgagttgccttcagtttttagtggcctggcataagcacgaagtcaaatacgacacactgattaccgacgtacaaaagtatctcgatacctattttgccgacctgaaatccactactgaccggctccagccgctgaccttagatacctgccagcaagctaaccccgaactgaccgcccgcgcagcgtttagcatgaatgtccgaacgtttgtgctggtgaaagataaaaaaacattctgttcatctgcgaccggtgagatggacattccactcaatgaattgattccggcgctcgacattaataaaaacgtcgatatggcgatcttacccggcacgccgatggtgccgaacaaacccgcaatcgtcatctggtatcgcaaccctttgctgaaaaatagcggcgtctttgccgctctgaatctcaacctgacgccttcactcttttatagttcacggcaggaagattacgatggcgtcgccctcattattggcaatactgcgctatctaccttttcttcacgtttgatgaacgttaacgaattaaccgacatgccagtccgtgaaactaaaattgcgggcattcctctgaccgttcggctttatgcagatgactggacatggaacgatgtgtggtacgcatttttactgggcggcatgagtggaactgtcgttggcctgctctgctattacctgatgagcgtacgtatgcgccccggcagagaaatcatgaccgccatcaagcgcgaacaattttacgtggcgtatcaaccggtggtggatacacaagctttgcgagtaacgggcctggaagtactgctacgctggcggcatcctgtcgcgggagaaattcccccggatgccttcattaactttgccgaatcgcaaaagatgattgtgccgctgactcagcacctgtttgagttaattgcccgcgatgccgcagaattagaaaaagtgctgccggtaggcgtcaaatttggtattaacattgcgccggaccatctgcacagcgaaagctttaaagcagatatccagaaactgctcacttccctgcccgcacaccatttccagattgtgctggaaattaccgagcgcgatatgttgaaagagcaagaagccacacaactcttcgcctggctgcactcggtcggcgtagaaattgctattgatgacttcggcaccgggcacagcgcgcttatctatcttgagcgttttacgctcgattatctgaaaattgaccgtggatttatcaacgccatcggtacggaaacgatcacttcccccgtacttgacgcggtgctgacgctggcgaaacgcctcaatatgctgacggttgctgaaggggtcgaaacgccggaacaggcgcgatggctaagcgaacgcggcgttaatttcatgcaaggctactggattagccgcccgttaccgctggacgattttgttcgctggctaaagaaaccgtatacgccgcagtggtaaggtgtgcttacgtcccttattattcatagtgaaagcatgccggattgcggctaatgatgagtaaaaggaaatccgttgcagatgattgtgcgcatactgctgctgtttatcgctctgttcacctttggtgtgcaggcgcaggctatcaaggaaagctatgcctttgccgtgctgggcgaaccccggtacgcgtttaatttcaaccattttgattatgtgaaccccgccgcgccaaaaggtgggcagataacgttgtcagccctcggcaccttcgataatttcaaccgctatgcactgcgcggcaacccgggcgcacgcaccgagcagctgtacgacacgctatttacgacttccgatgacgaaccaggcagttattacccgctgattgctgaaagcgcacgctatgctgacgattattcctgggtggaggtcgctattaatccgcgcgcccgttttcatgatggttcgcccattactgcccgcgatgtagagtttacttttcaaaaatttatgaccgaaggcgtgccgcaatttcgtctggtctacaaaggcaccaccgtcaaagccattgcaccgttaaccgtgcgcattgagttagctaaacccggcaaagaagatatgctgagtctgttttcgctgccggtatttccagaaaagtactggaaggatcacaaacttagcgacccgctcgccacgcctccgcttgccagtggtccgtaccgcgttacgtcctggaaaatggggcaaaatattgtctattcccgtgtgaaagattactgggcagcaaacttaccggtaaaccgtggacgctggaatttcgacaccattcgctacgattattacctcgatgataatgtcgcctttgaagcgtttaaagcaggtgcctttgatttgcgtatggaaaacgacgccaaaaactgggccacgcgttataccggtaaaaatttcgataaaaaatacatcatcaaagatgagcaaaagaacgaatcagcccaggatacgcgttggctggcgtttaatatccaacgtccggtattcagcgatcgccgggtccgggaagctatcactctcgcctttgactttgaatggatgaacaaggcgttgttttacaatgcctggagtcgcacgaacagttattttcagaataccgaatacgcggccagaaattaccccgacgccgcggagctggtgcttctggcaccaatgaaaaaagatctaccgtcagaagtcttcacacaaatctaccagccgccggtatccaaaggcgatggctacgatcgtgacaacctgttaaaagccgacaaacttctcaacgaagcgggctgggtgctgaagggtcagcaacgcgttaatgccacaacgggtcagccactcagctttgaattattgcttcccgcaagcagcaatagtcagtgggtattgccgttccagcacagcctgcaacggctgggtatcaacatggacattcgcaaggtggataactcgcaaatcactaaccgcatgcgcagtcgcgactatgacatgatgccgcgcgtatggcgggcgatgccgtggcccagttccgatttacagatttcctggtcatcggaatatatcaattccacttataatgcccccggcgtgcaaagcccggttatcgactcgctgatcaaccaaattattgccgcgcagggaaataaagaaaaattactgccgttggggcgagcactggatcgcgtattaacgtggaattattacatgctgccaatgtggtacatggcggaagaccgtctcgcctggtgggataaattctcccagccggccgtgcgccccatctatagcctcggtatcgatacctggtggtatgacgtcaataaagcggccaaactgccgtccgccagcaaacagggagagtagatgggcgcttacctgattcgccgtctgttgctggtgatcccaacattatgggcgattatcaccatcaactttttcatcgtgcaaattgcgcctggcggtccggtcgaccaggccatcgccgccattgagtttggtaatgccggagtattacccggcgcaggcggtgaaggtgttcgtgccagccatgcgcaaacgggtgtcggcaatatcagcgacagtaattaccgtggcggacgcggattagatccagaagtgatcgctgagatcactcatcgctacggttttgataagccgatccacgaacgttacttcaaaatgctctgggactacatccgctttgattttggcgatagcctgtttcgcagcgcctcggtgctgacgctgattaaagacagtctgccggtttccatcaccctcggattgtggagcacgctgattatctatctggtgtcgattccgttaggcattcgcaaagctgtttataatgggagccgctttgacgtctggagtagcgcatttatcatcatcggctacgccattccggcctttttgtttgccatcctgctgattgtcttcttcgcgggcggcagctatttcgacctgttccctctacgcggcctggtttccgctaactttgattcgctgccgtggtatcagaaaatcaccgattatctgtggcatatcacgctgccggtgctggcgacagtgattggtggctttgcggcgctgaccatgctgacaaaaaactcattccttgatgaagtgcgcaagcaatacgtggtgaccgcgcgtgcgaaaggggtaagtgaaaaaaatattctctggaaacatgtgttccgcaacgccatgctgctggtgattgccggttttccggcgacgtttatcagcatgttttttaccggctcgctgctgattgaggtgatgttttcactcaatggtctgggcttactgggctacgaagcgaccgtctcgcgcgattatcctgtaatgtttggtaccttgtatattttcaccctgattggcctgctgctgaatattgtcagtgatatcagctatacgctggttgatccgcgtattgattttgagggacgttaatgtcgcgactcagccccgtcaatcaggcccgttgggcgcgttttcgtcataaccgtcgcggctactggtcgttatggattttcctcgtcttgtttggtttgagtttgtgttctgaacttatcgccaacgataaaccgttgctggtgcgttatgacggcagttggtatttcccgttattgaaaaactacagcgaaagcgattttggcggcccgctggcaagtcaggctgattatcaggacccgtggctgaaacaacggctggaaaataacggctgggtactgtgggcaccgattcgctttggtgctaccagtatcaactttgctaccaataagcccttcccttctccaccctcccggcaaaactggctgggaacggatgccaacggcggcgatgtgctggcacgcattctctatggcacgcggatctcggttctgtttggcctgatgctgactctctgttccagcgtgatgggcgtgctggcgggggcgctacaaggctattacggcggtaaagtcgatctctggggacaacgctttattgaagtatggtcggggatgccgacgctgtttttgattattttactttccagcgtcgtacagcctaacttctggtggctgctggcaattactgtcttgtttggctggatgagtctggtcggcgtggtgcgggcggagtttttacgtactcgtaatttcgactacattcgtgcggcacaggcgcttggcgtcagcgatcgcagtatcatcctgcgtcatatgttgcctaatgccatggtcgcgaccctcacctttttaccgtttattttatgtagttcgataaccaccctgacctcgctcgatttcctcggcttcggtctaccgctcggttcaccgtcactcggtgaactgctgttacaagggaaaaataaccttcaggccccgtggcttgggatcaccgccttcttgtcggtggcgatattattgtctttgctgatctttattggtgaagccgtccgcgacgcatttgatcctaataaggcggtgtagcatgacgcaaactctgttagcgattgaaaatttgtcggtgggttttcgccatcagcaaaccgtacgtacagtagtcaatgatgtttcactacagattgaggctggcgaaacgctggcgctggtgggtgagtcaggttcaggcaaaagcgttaccgcgctgtcaattttacgcctgctcccttccccgccggttgaatatctctccggcgatattcgttttcatggcgaatcgctgcttcacgccagcgatcaaacgttgcgcggtgtacgcggtaataagatcgccatgatttttcaggaaccgatggtgtcgttaaatccattgcataccctggaaaaacagctttatgaagtgctttcactccaccgcgggatgcgtcgggaagcggctcgtggcgaaattcttaactgccttgatcgcgttggtatccgccaggcggcaaaacggctgacagattatccgcatcagctctccggcggcgaacggcagcgggtgatgattgcgatggcgctgttaacgcgaccggaattattaattgccgatgaaccgaccaccgcactggacgtctctgtccaggcgcagattttacagctgttgcgcgaactgcaaggcgagctgaatatgggcatgctgtttattactcataacctcagcattgtcagaaaactggcccaccgcgtggcggtaatgcaaaacggtcgctgtgtcgagcaaaattacgccgctacgctatttgcatcacccactcatccttacacacaaaagctactcaacagtgaaccgtcaggcgatccagtgccgttgccagaacctgcctcaacgttgctggatgttgaacagcttcaggttgccttccccattcgcaaagggattttgaagcgcattgtggatcataatgtggtggtgaaaaacatcagttttacgctacgagcgggtgaaacactgggtttagtgggcgagtccggttccgggaaaagtacgacgggactggcgctgctgcgactgattaattctcagggcagcatcatctttgacggtcagccactgcaaaatttaaatcgccgccagctgttacctattcgtcatcgcattcaggtggtatttcaggatccaaactcctcgctcaacccacgactcaacgttttgcagattattgaggaaggcttacgggttcaccagccgacgctttctgccgcacaacgcgaacaacaagtgatagccgtgatgcatgaagtgggattagatcctgaaacacgccaccgttatccggcggagttctctggtggtcagcgacaacgtattgcgattgccagggcattaattcttaagccctcgctgatcatacttgatgaaccgacatcatcactcgacaaaacggtacaggcgcaaatattgacgctattgaaatcattgcaacaaaagcatcaactggcctatttgtttatcagccacgatttgcacgttgtccgcgcgttatgtcatcaggttatcatactgcgacaaggggaagtagtggaacaaggaccgtgcgcgcgcgtgtttgccacaccgcagcaggagtatacgcgtcagctactggcgttgagctgacgcttaaaaaggattgtagtttgaaaagggttcggcaattgccacaccaaaatttttcaatcggcatgttgcagcaaactcgtcctggcgatttacaaacaggcacggctcaccttcacactccagcaccgaacatggaacttcgatgtcgcttaacgcctggcttagtttatacatcaccgaccatgcattatcaccatccgggctaagcaatttaagcgccaccaggctgttgtcaccgcacggtccattttgcggaatcggttcaaccttcgaacctgcgaaaccagcagaccagcgatagttctgcggcagtcgatggacgattgagagttgtaatgaagtcacttattttccccggaagcacattcacttcacaatttgtttacatcaattttaacacatcatcaacaatccgtctttatacagatcgtaaagattgatgcctcgcctgcgtggcctctatggctctgatttaagtaatatctgcgggcgtggtcacgtttgcggggctatatgtacccgtttctgcgatctaactc

SEQ ID NO: 43 - protein, 535 aa, Artificial Sequence
  Description of Artificial Sequence; note = synthetic construct
MYTRNLLWLVSLVSAAPLYAADVPANTPLAPQQVFRYNNHSDPGTLDPQKVEENTAAQIVLDLFEGLVWMDGEGQVQPAQAERWEILDGGKRYIFHLRSGLQWSDGQPLTAEDFVLGWQRAVDPKTASPFAGYLAQAHINNAAAIVAGKADVTSLGVKATDDRTLEVTLEQPVPWFTTMLAWPTLFPVPHHVIAKHGDSWSKPENMVYNGAFVLDQWVVNEKITARKNPKYRDAQHTVLQQVEYLALDNSVTGYNRYRAGEVDLTWVPAQQIPAIEKSLPGELRIIPRLNSEYYNFNLEKPPFNDVRVRRALYLTVDRQLIAQKVLGLRTPATTLTPPEVKGFSATTFDELQKPMSERVAMAKALLKQAGYDASHPLRFELFYNKYDLHEKTAIALSSEWKKWLGAQVTLRTMEWKTYLDARRAGDFMLSRQSWDATYNDASSFLNTLKSDSEENVGHWKNAQYDALLNQATQITDATKRNALYQQAEVIINQQAPLIPIYYQPLIKLLKPYVGGFPLHNPQDYVYSKELYIKAH

SEQ ID NO: 44 - DNA, 11227 bp, Artificial Sequence
  Description of Artificial Sequence; note = synthetic construct
taatcaaaggccggggattataagccggaacgaaagagaaatcgaaaggtattccatactcgccctcctcgggcgagtatgaagattacggtaccggattgaccaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacattacgccttcaatatggaacgcttgcggctcgtccgcgcgtaccgtccagcgttcccacgttccttgctgcgcggtgacatcaatacggttgacgtcccacagctgtccattaatacccgggtcatcacccagactgatatcgcgactgcgaattggcgaaccagccatgatttcagttggcagcaagcgcatcggaagactgtctgtgaccagcggcagaaggccggttgggcgcagcgttagcaccagggtagaaaccagaatactggatggctcaaagaagccacgaatacgatcaacaatgctcgccgcttcgccacaggtgatcgacacttcatcgccgttgctcatatccaccagaatctcgcggcgctcgcccggtgccagcgaaagttgcttcaccgatacaggagcaggcaggaatccctgatcgccagaaatcacatgtaacgggcgaccatcgttcatctgtagttgatagcgacgagagttcgacgcgttcagcagtcgcaagcgcacccagccacgcgagacttcaacgtacgggctttgtacaccgttaaccagcagcgtatcaccaacaaagccgccgcttcccggttcgttgtattctggcgtaccaaagttatccagccgtttatcctggataatgaccggaaaatcatccacaccataatggttggggataggcagcgacttgctgacttcatcttccaccagccacattccggcaaggccgttatagacctgctgagccgtgcggttgggagtattggcgtgataccacagagtagctgcgttctggcgaatgggcagtacgggtgcccagtcagcgtttggcgacatcatccgtgccggaccgcccatcagcgggcctggtacctgtagcccggccaccgtcattgagacattttctgtcaggcggttgctgtaaataagcttaacatcgtcgcccttccagacgcggatagtcggccccaggtaacgaccattgattccccagaccgacgcgcgtgtccctggcgtaaatgaccagtgcgcacgttgtacagtcataaacagcggttgcccacggcgagattcaagtagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccagctcacgaacctgatctttgccatactgactgacgtcaattggcggcagcatttcgacaatcaccagaccgttgtgcagtcgattaagattaatcttattcgaagttgtagagacgcacacgggaataatcgggacgcccgccgcaattgccgcgtgaaatgctccagtcttgaacggtagcaggccgcgaccacggctgcgggttccttccgggaacatccagatggaaatacggcgttttttgaagtgattcactacttccgcaatggtgccgtgagctttagtgcgattgtttctgtcgatcaataagttgccggttaaccagtacaactgcccgaagaaggggatccacagcaagctctttttacctaccgtcaccgtcggcggttgcacgatgttcgatgctgtcaccatgtcatagttgttctggtggttagcgatatagatagcattgccgtagctttcagcgtctgtaggtttacggcactcaactttcaggccaaacagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaatcaggttagggcattgttaaaagccgctctctggaaaagcgtattgttaatcgcaacgcatgaataaacaacggtttcaagggaatttttatcgtttccgggggttgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagtgactttctgtaactcttccgggcgcagtttaattttgcgtttcccaacatgaatggtcagcgtgctttgcggcggcagaacgtacaattgcgccagaccatcttctccacgcgcggcttctgccgatggaatgttgataatcttgttgcctttgcccttcgacagctgcggcagatcacttaccgggaacatcaacatacggcctgcctgagtgattgccagcagcatatcggaagcatcttcaatcaccaccggcggcataacatgggcattttccggtaaggtgatcaaagccttacctgcacggttacgcgccaccagatcgttaaaggtgcagacgaaaccgtaacccgcatcggaagccatcagcagtttctgatcgtcgctttccatcagcatatggtcaacggtcgccccaggcggcaacgttaatttgccggtgagcggctcgccctgaccacgcgccgacggcagcgtaatcgggtcaatggcatagctacgaccggtggaatcaacaaacactaccggttggttgctcttacctttcaccgccgctttgaagctatcacccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgatcgtcaccgtaggcttgcgcgtctgcctgcagttctttcttcagcaggttattcattttacgctcggaagccaaaatgccctgcaactggtcgcgctctttttccagttcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattaaggttaatacgatagctcttttccagatcggtggtagcgaagaggtggttcatcacctgatccatatccacgcggttggaacgcggcacaatcaccaggcgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccacaccgcgcgcatacgcactgaaccacgtccgttctcgtagattttacggatctcggcgcgcgaagtgataatttccgcttcagtcggataatccggcccctgcacgatatccagcagctgatcgagcgtggttttcggctggtcgattaatgcgattgccgcctgagccacttcacgcaggttatgcggtggaatatcggtcgccatgccgacggcaataccggtggtgccgttaagcaaaatgtttggcagacgggcaggtagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgcgccccagttcccctgaccatcaaccagcggataacggtaagagaacggttgcgccatcaggaccatcgcttcataacaggcgctatcgccgtgcggatggtatttacccagtacgtcaccgacggtacgggccgattttttaaatttggcgctggcattcaggcccagttcagacatcgcatacacaatgcggcgctgaacaggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcaacgtgaatagcgccgccggacgtgctccgacggcgataaaggcatcaatgtgccttgatatacaactctttgctgtagacataatcctggggattatgcagcggaaaaccgccaacgtagggtttaagcagtttgattaacggctgatagtagataggaatcagcggtgcctgttggttgatgatcacttctgcctgctgatacaacgcattacgctttgtcgcatcagtgatctgcgtggcctggtttagtaaggcgtcatactgcgcatttttccagtgaccgacgttttcttcactatcgcttttgagcgtgttcaggaagctggaagcatcattgtacgtcgcatcccacgactgccgagacagcatgaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaaggcttttgccatcgcgacgcgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcactcgcacatcgttaaatggcggtttctcaaggttgaagttgtaatattcgctgttcagacgcggaataattcgtagctcgccaggcagtgatttttcaatggcgggaatttgctgcgccggaacccaggtgagatcgacctctcccgcgcgatagcggttatagccggtgaccgaattatctagcgccagatactcaacctgttgcaatactgtatgttgcgcatcgcggtactttggatttttgcgtgcagtaatcttttcgttaactacccactgatcaagcacaaaggcaccgttgtaaaccatgttctctggcttactccagctatcgccatgtttagcgatgacatgatgaggaaccgggaacagcgtcggccaggcgagcatcgtcgtgaaccaaggaaccggctgctcaagcgtaacttcaagagtacgatcatccgtcgctttgacacccagcgatgtaacatctgctttacccgcaacaatagctgcggcattgttaatgtgcgcctgtgccagatagccagcaaaagggcttgccgttttcgggtcaaccgcgcgctgccagccgaggacaaaatcctctgccgtcagaggctgaccgtcggaccactgcaaaccgctacgcagatggaaaatatagcgcttgccgccgtccagtatctcccagcgttcagcctgagcgggctgcacctggccttcaccgtccatccataccagaccttcaaacagatccagcacaatctgcgcggcagtattctcctccaccttttgcgggtcgagcgtacctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccaacaacaatacgcctgtggcattgttcgctcaaacttatcgcgagtgatttggctcacactccggtaaagaaaaaagcgagttgcccccgcttttccattaattaacggatttcattcaatagttctggatgcttatccagaacacgtaaaagtttgattgtggaaggatgaggttgggcattgcctttttcgtaacgcgaaaacgcatttacacctcccccaaaaatttcgcttgcctctttttgggtaagagagagcttttttcgaaccttcactataaattcaggtgccactgtttcggcattcaccgaagcccgaaatgcctttacttgcgccatgaaagcatctgactcttctttattcatgatgctctcttcgcaatggacacaatataaaccgtggatacctttcaatactgtttttcgtccacggaaggtgtatggaatatctttaatgccagaaaccatttctccctggtggcaaaccggacatttcatattacttctccttaaacgagacgatcagtacgtcatgaattaccgtaattttaagataaacctggcctgtaacaagcctgggtctgtaaacatcctgccagatagtatgatcagagtaggtggtcatgcttttataaaagtcgctctctgataatccaatgataacattacacataccatcaaaatccaaacctaactcatctgcatttaacagggcactacgtgttgtacgaacttgcccggcattgacaagttttttaacctgactcaaacgtgtatgtggtgtgcgtttttccataacccccgcctccctgttactttagttataacctaaaaggttaattacagcaatgaaaaagcacctaaaaggttagttagatgtacggagatagtgaccacacaaaacgtattctttaaggaaagtgattgaccatataagaaagtggcgcattagtagcgccagtttgaagcaggaatttataagggaagctggagtcaggcatcacgccaacggcacataaacatccgtttccagtcgctgctctgtcaccccttcggcaagattggtgtagtgaaacagaatcggtgctttacgcattttctcgccgcttgcaggcagccagtggcgaatgatgccccataccgtgtgtgaaatatcgtccagctcgccaagctggcgggccacggcataacgtccaccggtaagttcaccattgctcacaccataacgattatcgggaatcggttcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctgtagttgagcaattcagggctacagcggtgcggcaacatcgccacaggtattgatgggaaatcgataatgtttacatccagtgtcaggtttgtcattttgcctccctgcgaaattattcccgggaacgcgtcccgggagcggtaacaattacggatttactttgcggatctgtttgacgtcaatttcaacagaattccagtctttatcgacttcaccctgaatctcaaccgtatctttcggcgtcaccgtcacgccgttccagcgtttgtggtcgatatcaacattgatagtaccgctggcatctttgaacacgtagagatcgtcagagatgcgttcaacgatattgccgcgcagggttacccaggtgtcgtcacgcagggattttgcgctttctacagtcgttacgctgccgttcggcccctggaatcctccggcctgactttgcgttgccgatgggccagaaaaaccgccctgctctgctgccatcaccggtgcgctgcacagggccattactgcgattactgctgcgaattttttcatgtttattactccctttaatgtctgtttccgagcatttaacaagatagtccttaacaacttcttaagggaaaaaaataaaatttagtgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgtcgcgcaaactgattgaagagaaactgtatacctgggacgaagaggtcaccagtaatgccgttgaagtgcatgtgcatcatctgcgacgcaaactcggtagtgattttattcgtaccgtgcatggtattggttacacattaggtgagaaatgaaatttacccaacgtcttagtctgcgcgtcaggctgacgctaatctttttaattctggcctcggtgacctggctgctttccagctttgtcgcctggaaacaaacaacggataacgtcgatgaattgttcgacacccaactgatgctgtttgccaagcggttaagtacgctcgatctcaacgaaatcaacgcggcggatcgcatggcacagacgccaaatagattaaaacacggtcatgttgatgacgatgcgctgacctttgccatctttacccacgacggcagaatggtccttaatgatggcgataacggagaagatattccctatagctatcaacgggaaggttttgctgacgggcaactggtcggtgaagacgatccttggcgttttgtctggatgacctcacctgatggcaaatatcgcatcgttgttggccaggaatgggaataccgtgaagacatggcgctggcgattgttgccgggcaattgatcccgtggctggtcgcactgccgattatgttaatcatcatgatggtactactgggtcgtgaactcgcgccgctgaacaaactggcgctggcactacgtatgcgtgaccctgactcggaaaaaccactaaacgcgactggcgtacccagcgaagtgcggccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgcgcagctctctgacgatgatccgcaggcgcggaaaaaagcactgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaaaattgacgtgcgactgacactcaatgcccacagcatcaaacgcaccgggcaaccgctattgctaagtttgttggtgcgaaatttgctggataacgccgtgcgctacagtccacagggcagcgtggtagacgtcacgctgaatgctgataatttcatcgtgagggataacggccccggtgtgacaccagaggcactggcgcgaattggcgaacgcttctatcgcccacccggacaaaccgctaccggcagcgggcttgggctatcgattgtccagcgaatcgccaaattgcatggcatgaatgttgaatttgggaatgcggaacaaggtggatttgaggcgaaggtaagctggtaacttctctgtctatgagagccgttaaaacgactctcatagattttactaatagcaaaatataaaccgtccccaaaaaagccaccaaccacaaaccagacaaataccgagcgagaatacatatacccaaaactcgaacatttcccgcataaagagttttcttaagataagaataataagtggcgtaagaagaaaaaatgctgcaatcattgcttgcaatatacgatcttcgcctgaaacggaaggtatactgcaaatatttcctcccgactcaagcatccagtcatacttattgaaagcaaaaaaagaatctattaaccaataagtaagcattatatatagcaatgcttcaaatattgttttaattttctgctttaacatatatcagtacgctcataaaaatccatttataattatcaacatgacacgttgatactttcatcttttacttattcaaagccatattttcaatccccaaaaaaaccgaaccaaacgtgtaaattattccggtgcgagtaagaattatgaggaatggctatcagtattgtcattttcagaaaatatttat

SEQ ID NO: 45 - protein, 185 aa, Artificial Sequence
  Description of Artificial Sequence; note = synthetic construct
MKFKTNKLSLNLVLASSLLAASIPAFAVTGDTDQPIHIESDQQSLDMQGNVVTFTGNVIVTQGTIKINADKVVVTRPGGEQGKEVIDGYGKPATFYQMQDNGKPVEGHASQMHYELAKDFVVLTGNAYLQQVDSNIKGDKITYLVKEQKMQAFSDKGKRVTTVLVPSQLQDKNNKGQTPAQKKGN

SEQ ID NO: 46 - DNA, 17801 bp, Artificial Sequence
  Description of Artificial Sequence; note = synthetic construct
ttgaatattcctgatagggcaagtcttcacccaccccggctgttcggcctgcccggcataactccttaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcctgccagtacccagaaagtgattactgcgctggcggcgttgattcaactcggccccgattttcgttttaccacgacgcttgaaaccaaaggcaatgtggaaaacggcgtacttaagggtgacttagtggcgcgatttggtgccgatccgacgttaaaacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccgtctcgctctacagtgccccaaagcctggtgatatggcttttatacgcgtggcatcttattaccccgttacgatgttcagccaggtacgcaccctcccccgtggttctgccgaagcgcaatactgcgaactggatgtggtgccaggcgacctgaaccgctttacgctgacgggatgcctgccacaacgttctgagccgctcccgttggcttttgccgtgcaggatggagccagctatgccggtgcaattctgaaagatgagttaaaacaggcgggtatcacctggagcggaacactgctgcgccagactcaggttaacgaacctggaacggtagttgccagtaaacagtcggccccgctgcacgatctgcttaagattatgctgaaaaagtcggacaacatgatcgccgatacggttttccgcatgataggccatgcgcgcttcaatgtgcctggaacatggcgggccgggtcggacgccgtgcgtcagatcctgcgccagcaagccggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagcgagcgggcaacgaatggcgtttgtgcaatatctttctggctatgcagtagaacctgcggatcagcgtaatcgccgtattccgttagtgcgttttgaaagccgtttgtataaagatatttatcagaacaattagtcaaaaagaaaccccggcacatggccggggcttcagattattgacaaagtgcgctttgtttatgccggatgcggcgtaaacgccttatccggcctacaaaatcgtgcaaattcaacatattgcaattctcttgtaggcctgataagcgtagcgcatcaggctgatttggcgtttatcatcagtgattaacgcttgtaaatgaactcaacgccttcttcgtcgtcttcgtcccagtcgtcatcccagtcttcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccactcgccgcagagatcagataatatttatcttcccagcccagcgcctcagcgatcgctttcgctttctcttcggcttctaccttatccagcagatcgatcttgttgaacactaaccaacgcggtttcgtcgccagatcctggctgtatttttccagctcgctgataataatacgcgcgttttcaaccggatcggtgccgtcaatcggatcgatatcgatgaggtgcaacaggacgcggcaacgttccaggtgcttcaggaagcgaatgcccagacctgcgccttccgcagcgccttcaatcagtcctggaatatcggcaacaacgaagctcttttcgttgtccattcgtaccacacccagacttggcaccagagtggtaaacggataatccgccactttcggtttagccgccgataccgcacgaataaaggtcgatttacccgcgtttggcatccccaacataccgacgtcagccagcagcatcagctccagcagcagctcgcgcttatcgcccggcgtgccgttggttttctgccgcggtgtacggttaacggacgatttgaaacgggtattgcccagaccgtgccagccgcccttagcaaccagcagacgctgaccgtgtttggtcatatcgcccatggtttcaccagtaccctggtcgattacacgcgtacctaccggcactttaatcgtcacgtctttaccgcgcttaccggtacagtcgcggcttgcgccattctgaccgcgctctgcacggaaagatttttcaaaacgataatcgataagcgtgttcaggttctcgtcggcttccatccatacgtcaccaccatcaccgccgtcgccgccatccgggccgcctttcggaatatacttttcgcggcggaagctcacgcaaccattaccgccatcacctgcaacgaccagaatcgatgcttcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaaggtattcagtccgcaaaaaattaaacatgcgagctgccagtggctaagctgcgctatcactccaggctttgccagagggaagagcgcaattgtacataaagtgtacagtaaaaacaggatctgcggtgaggccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggccgctcaggagcatcaatgcccctacaacctgagtgctgcgcattttctctttgaggataaatacgctggcaaccatcatgccaactggcgagagttgcccaatcacctgcgaagcggtcggactcaggtattgcaaggatgagctgaacaggatgaagttcccaaacagcccggcggtcgccactgccaacaaaatcaaccagcgtggcttacgaaacacgcgtaatggcggcaacctcttcttcaccgcaagaatggcacccaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacgtcgcaccatgcgcatttttaccggttatcgaatgtaaaaagccccgcaacgtgttgcggggctttcatccgttaccgggacgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaggcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaactttctcgccacgaccgtgagcaacaacttcagctttgattacgccgccatcaacgaaaggaacgccgattttgacttcttcaccgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcgctcaaagtgctggaagtcatgtcagaagccgtaaacgtcatcgcagaaggtgaagttctgcaactgatgaacgttaacgatccggacatcactgaagaaaactacatgcgcgttatctatagcaaaaccgcgcgtctgtttgaggctgccgcgcagtgttccgggattctggctggctgtacgccggaggaggagaaaggcctgcaggattatgggcgctatctcggcactgctttccagttgatcgacgatttactcgattacaatgccgatggcgaacagttaggtaaaaatgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccttggcgagaagcactcatcggcctcgcgcacatcgctgttcaacgcgatcgttaatcccctcccctcatcccgcgcagcgcgcgggatggttccagtaagttccataaaaacacttattcagctctataacacctgaaaaatagggatgtgcatctttatatattctgaatattcacactctttacaggaactttttagagcaataggccatcaggagtatagtgatgctcgacagaagaagtgttctgaatgaaagcgactaacttaaggagtgaggaaaaatggaaagtaatttcattgactggcatcccgctgacatcattgcgggtttgcgcaagaagggaacgtcaatggcggcggaatctcgcagaaatggtttgagttcctcaacgctggcgaatgcattatcgcgcccatggccgaaaggagagatgattattgcgaaagccctgggaactgacccctgggttatctggccatcacgctaccatgatccgcagacccatgagtttatcgacagaacgcagttgatgcgtagctacactaaaccgaaaaaatgagtggtctggcggtagccccgcgaacggggctgccagctctcagacgattattcgcctttcacacgctcaatatttgcacctaaagcgcgcagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacggctcagctctggcacatgcataaagcggttttcaaagaccgtttcggtgataaacccggtcccttctgccaccaggttcaacagcgtgaactgggcctgcatatcggtcgggaatgccggatgcggcgcggtacgtacgttaacagccttcggacgtttgccatgcatatccaggctaatccagtcttcgccgacttcgatgtccgctccagcgtcacgcagtttcgccagcacggcgtcgagagtatctggctgcgcgttacggcagataattttgccgcgagaaatcgccgccgccaccaggaaagtaccggtttcgatacgatccggcagaacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgccagggttgcagcacacatgatggtcaccgttgcgccaacgctgactttatccatcacgatatgtgcacctttcaaacgaccatcgacggaagctttaacgtaaccttcttccagtttgatggtcgcgcctaattgttcgaggccagaaatgtgtagatcaaccggacgcgcaccgatcgtacaaccgccaggtagtgaaacttgcccctgaccaaagcgcgctaccagcggccccagcgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtctttcagtttcgggacgttctggatctctaccggttcttccgccagtagtgcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcggaccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaaccagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccccccgtatccacgcgggagacacggctaagatcgatgcaggtaatccccttcaccgcttcctcacgcatttcccaaagcggtagcaaaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccaattgcccgtctgggagtttttacgccactggaagtccagacgcaccggcggacggccattcgggtcaataatggtaacgcgaataggcacaatggttttatcgcccagcggctgttctggcgcaatctgataggtttgaccgtgatacatcgccagcgcctgaccgtaagcctgcttcaggtactcacggaaagcggcaaagtaggcttcacgttgagcaggggtcgcactcttgtaatactggcccagcaccagcgcaccggcgtatttcacctgtacgtatggcagcagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagaggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttagtgtcctgaattgtatcgccatccttcaggatagcagtccccagttccgggtcttcaaaaccgacgtttaatgccagatattgttcccccagcaggccggaagtacgaatgctcagcgaactggtatctggaatgtggttataacgttgttcaatttccagcgttacgcgcggcagataggttttcgggtccagcgtaatatccgccacccgacccacaacaacgccaccaatactgaccggagagcgcgctttcaggccgccaatgttatcgaacgtcgcataaagcgtgtaggtcggttcagtacgtatggacgtcacgttcgccgccttcaggcaaacaaacagcgccgccagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgaccagatccatacgccagtcgacggcattttgcattgccgaccagaagaacccgctatcaatgcctttccaactgacgccgaccagagatccgccccagatccccacggcgacgaaaataaccgtcaacagtggtaatgaaataaccccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaaccacaataatcagcatcgacaggacgccgacattatagagctggcgcaccagcagcggcgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagtacgcccatggtgatgggatcttgcccaacaaaaggttcatcaaacatgatgagatccggctccagcgcaatcgcacgcgccagcgctgcacgccgcgccatcccaccggaaagttcagaaggcattagtttagccgctccacgcagccccacggcctccagcttcatcatcaccgtactatgcaacaatggcgcgggaagttgggtatgttcgcgcagtggataggcgacgttgtcaaatacgttcatatcagtgaacaacgccccggactgaaataacatgctcatccgtttgcgcactgtatacaggcgcgaacgagacatcgccggaatattctcaccatcgaaaaggatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacccgccgtggttagcgaaagctggcatttgttttactttttagccgcataaagtcaaaattaagcatccgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgctgatcatcggcatgacggtggtcagtattggtacatcgttaccagaagtcatcgtctcgcttgccgcgtctctgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgacggcggattgcccgtcgcgtttttatggctcggcattgcgcttatcatcatgccagtggccacgcggatggtggttgataacgccacggtgctggcgaattactttgccatcagcgagttgacgatgggtctgacggcaattgctatcggaaccagcctgccggaactggcaaccgcaatagcgggggttcgcaaaggtgaaaacgacattgctgtcggaaatatcattggcgcaaacatttttaatattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatgggaaaatcggggcatattgggcgaaaaatggcggcaacgtttgccagcaccggtacaccttcatttttcgtccatcctggtgaagccgcgcatggtgatttaggcatggttaccccacaggatgtggtgattgctatctctaactctggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcaccaccgccacgctggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcgttgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgtgtgcgccctggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatagcaaaagcagagaacattcgtctgctgatcctcgatgtcgatggcgtactgtcagatggcctgatttatatgggcaataatggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgcgaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatggacacgttgaagtcaacgcacttgtgccagactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggtaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcccagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaacaaccgttctggtgccgtcgcagctgcaggacaaaaacaacaaaggccagaccccggcacagaagaagggtaattaattcgttatggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgtaggcattgtgccgcgcgatgcgggcaacatcattattgatgatgacgatatcagtctgctgcctctgcatgcacgcgcgcgccgcggtatcggctatctgccacaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagtaatccgctgcttgagcaaatcgacactcatgaagaaatcgacacccgcgaaacgcaagacagtgaaacgctggacaccgccgacgcgctcgaacaaaaagagatgccggaagagctgccgctcgatgccagttgggacaccatttacaccgctggtacaccatccggcaccagcggtgactacattgacgacgagctgccggtctaccagggcgaaacgacgcagaccttgcaggattacctgatgtggcaggttgagctgacaccgttttccgacactgaccgcgctattgctacctctatcgtcgatgccgttgatgaaaccggttatctgactgtcccgctggaagatattctcgaaagtataggcgatgaagagatcgacatcgacgaagttgaagccgtccttaagcggatccaacggtttgatccggtcggtgtggcggcaaaagatctgcgtgactgtctgctgatccaactctcccaattcgataagaccacgccgtggctggaagaggccagactgatcattagcgatcatctcgatctgttagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtctgcaaatcaaccagcactacgcctcgatgtgcaataacgcgcgcaacgatggtgacagccagtttatccgcagcaatctgcaggatgccaaatggttgatcaagagtctggaaagccgtaacgatacgctactgcgcgtgagtcgctgtatcgttgaacagcagcaagccttctttgagcaaggtgaagaatatatgaaaccgatggtactggccgatatcgcccaggctgtcgaaatgcatgaatcgacgatatctcgcgtgaccacgcaaaaatacctgcatagtccacgaggcatttttgaactgaagtatttcttttccagtcacgtcaataccgagggcggcggcgaagcttcctccacggcgattcgtgcgctggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacaactcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaagtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggtctgttgtgcggcacaacgggccatttgtacggttaat

SEQ ID NO: 47 - protein, 305 aa, Artificial Sequence
  Description of Artificial Sequence; note = synthetic construct
MQCGISDGLPGFSYADADGKFSGIDVDICRGVAAAVFGDDTKVKYTPLTAKERFTALQSGEVDLLSRNTTWTSSRDAGMGMAFTGVTYYDGIGFLTHDKAGLKSAKELDGATVCIQAGTDTELNVADYFKANNMKYTPVTFDRSDESAKALESGRCDTLASDQSQLYALRIKLSNPAEWIVLPEVISKEPLGPVVRRGDDEWFSIVRWTLFAMLNAEEMGINSQNVDEKAANPATPDMAHLLGKEGDYGKDLKLDNKWAYNIIKQVGNYSEIFERNVGSESPLKIKRGQNNLWNNGGIQYAPPVR

SEQ ID NO: 48 - DNA, 11095 bp, Artificial Sequence
  Description of Artificial Sequence; note = synthetic construct
tttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaagattcgcaccggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggcgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgcgctgatgatgggcatcaaccgtggtacgctgcgtaaaaaattgaaaaaatacggcatgaactaattcaggttagctaaatgcttgattaaaaaggcgctactcggcatggggaagcgccttttttataggtgtcacaaagggagtgaccatgagaacaggatgtgaaccgacccggtttggtaatgaagctaagaccattattcacggtgatgcgcttgccgaacttaaaaagatccccgccgaaagtgtcgatctgatctttgccgacccaccatataacatcggtaaaaattttgatggtctgatcgaagcctggaaagaagatctgtttatcgactggctgtttgaagtgattgcagagtgccaccgcgttctgaaaaagcagggcagcatgtacatcatgaacagtacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacattcaacggtgatgctattctggtagaagccaaaaccggatcgcagcgcgcgttgatcgattatcgcaaaaatcctccacagccttacaatcatcaaaaagtaccgggtaacgtttgggattttccgcgcgtgcgttatttgatggatgaatatgaaaaccacccgacgcaaaaaccggaagccttactgaaacgcattattctcgcctcttccaacccaggcgatatcgttctcgacccgtttgctggtagctttactaccggtgccgtagccatcgccagcggacgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattacaaagtaaaggatgtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtgaatttacatgacacttaattcattcgtttgatgaattaatttcgttatgttttcatctggcatgaacattcttaatacgttatcgaccagagcgggggcttgtttataaagatcataacccgccatattcattaaccagttttgaacaattccgctgaaggcaccatcaataataatcatcacaacatctaaatcgaggttatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaagccgacaatcaatttttcacgcaattgttgaaacgggtcatgctctaatccagccgtcaagtgttcctggattaactcccgcaatgaaggctgttgcaaccacatctcattaaacagttgagtcttgttttcgaagtgccagtagatagcgccacgcgtaacgttagcggcgtcggcaatgtcgttgagcgtcgtcttgcttacgccatgctgcgcaaactgggcgatggcagtttcaatcagttcttgccgggtcttcagagcttcggctttggttctttttgccatgattaattattcaggaaataaatatattcgacacagagtgagaaaatagcgaaggttaatctatcacctaatgtgtatttatacgagaggctaatattgagttgctataaatcgttaaataaataatatatattatttacctaagatacattcactacatcaatatatatttcaatttacgaggttttaattctgcctctttcaacccgcgtcaaaataaaacagtagaatattaatctttttttgtgtttatgtgccttgagatgcctgtattcataactattccttacatcgacgaatgataatttgtaggatagcgaactgtatttttctttctgcgagttaacgcgttgcctttttgggtaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtaaaaacggccccgttagaagttaagactgaattaccaggccgcaccaatgcttatcgtatagccgaagttcgcccacaggttagcgggatcgtactgaatcgcaatttcactgaaggcagcgatgtgcaagcaggccagtccctgtaccagatcgatcccgcgacctatcaggcaaattatgacagcgcgaaaggcgaactggcgaaaagtgaagccgccgccgccatcgcgcatttgacggtaaaacgttacgttccgctcgtgggtacgaaatacatcagccagcaggagtacgaccaggccattgctgatgctcgtcaggccgatgccgccgtgattgccgcaaaagccacagtcgaaagcgctcgcatcaatcttgcttataccaaagtcactgcgccaattagcggacgtatcggcaaatcgactgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggaaaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgtgcacggattgatgaaggcgtccaacctgacgccattcttatcccgcaacaaggcgttagccgcacaccgcgtggtgatgcaaccgtgctgattgttaacgataaaagtcaggttgaagcgcgccctgtcgttgccagtcaggcgattggcgataaatggttgattagtgaaggactgaaatctggcgatcaagtcattgtcagcggcctgcaaaaagcgcgtccgggagagcaggttaaagccactaccgatacccccgcagatactgcatcgaagtaaggtaatctgacatggcaaacttttttattcgacgaccgatatttgcatgggtgctggccattattctgatgatggcgggcgcactggcgatcctacaattgcccgtcgctcagtatccaacaattgcaccgcctgcggtttctgtttcagcaaactatccgggcgctgatgcgcagaccgtgcaggatacggtgacgcaggttatcgaacagaatatgaacggtatcgataacctgatgtatatgtcctccaccagcgattccgccggtagcgtgacaattacccttaccttccagtccgggaccgatcctgatatcgcgcaagtgcaggtgcagaacaaactccagctcgccacgccgttgctgccgcaggaggttcagcagcaggggatcagtgttgaaaagtccagtagcagctatttgatggtggcgggctttgtctctgataacccaggcaccacacaggacgatatctcggactatgtggcctctaacgttaaagatacgcttagccgtctgaatggcgtcggtgacgtacagcttttcggcgcacagtatgcgatgcgtatctggctggatgccgatctgctaaacaaatataaactgacaccggttgatgtgattaaccagttgaaggtacagaacgatcagatcgctgccggacagttgggcggaacgccagcgttaccagggcaacaattgaacgcctcgattattgctcagacgcggtttaaaaatccggaagaattcggcaaagtgaccctgcgcgtaaacagtgacggctcggtggtacgcctgaaagatgtcgcacgggttgaacttggcggtgaaaactataacgttatcgctcgtatcaacggaaaaccggcggcgggcctggggattaagctggcaaccggcgcgaatgctctcgataccgcgaaagccattaaggcaaaactggcggaattacagccattcttcccgcagggaatgaaggttctctacccttatgacaccacgccattcgtccagctttctattcacgaagtggtaaaaacgctgttcgaagccattatgctggtgttcctggtgatgtatctgttcttgcagaatatgcgagcaacgctgatccccaccattgcggtacccgtggtgttgttagggacgtttgccatcctcgccgcttttggttactccatcaacacactaacgatgttcgggatggtgcttgccatcgggctgctcgtcgatgatgcgatagtggtggtggagaacgtcgagcgcgtgatgatggaggataagctcccgccaaaagaagcgacggaaaaatcgatgtcgcaaattcagggcgcactggtgggtatcgcgatggtgctgtcagcggtatttattccgatggcattcttcggcggttctactggggcaatttatcgccagttctctatcaccatcgtttcggcaatggcgctttctgttctggtggcattgattcttacccctgcgttatgtgcaacgctgcttaaacccgtctctgctgagcatcacgaaaataagggcggtttcttcggttggtttaataccaccttcgatcatagcgttaaccactacaccaacagcgtcggcaaaatcctcggatccacaggacgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagttacggattactatctgaagaacgagaaagcgaacgttgaaagtgtctttacggttaacggctttagcttcagcggccaggcacaaaacgccggtatggccttcgtcagtctgaaaccgtgggaagagcgtaatggtgacgaaaacagtgcggaagcggtaatccatcgtgccaaaatggaattgggcaagatccgcgacggttttgtcattccattcaatatgccagccattgttgaactgggcacggcaacgggtttcgactttgagttaattgatcaggctgggctgggtcacgatgccctaacccaggcccgtaaccagttgcttggtatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgctgggtgggacttacgttaacgacttcatcgaccgtggccgcgtgaaaaagttgtatgttcaggcggatgccaaattccgtatgctgccagaagatgtcgataaactttatgtccgcagcgccaacggcgaaatggtgccattctcggcctttaccacttcacattgggtgtatggctctccgcgactggaacgctacaacggtctgccgtcaatggagattcagggggaagccgcgccaggaaccagttccggcgatgccatggcgttgatggaaaaccttgcgtcaaaattacctgcgggcattggttatgactggacgggtatgtcgtatcaggaacgcttatcgggaaaccaggctcccgctctggtagcaatttcctttgtggttgttttcctgtgccttgctgcactctatgaaagctggtcaattcctgtctcggttatgttggtagtgccgttagggattgtcggcgtgctgctggcggcgacactctttaatcaaaaaaatgacgtctactttatggtgggcttgctaacgacaattggcttgtcggccaaaaacgctattttgatcgttgagttcgctaaagatctcatggagaaagagggtaaaggtgttgttgaagcgacactgatggcagtacgtatgcgtctgcgtcctatcctgatgacctctctcgcctttattctcggcgtattaccgctagctatcagtaacggtgccggcagtggcgcgcagaacgctgtgggtatcggggtaatgggaggaatggtctctgcaacgttgctggcaatcttcttcgtaccggtgttctttgtggtgatccgccgttgctttaaaggataaatcagaaacataaaggcgctttcgggtgcctttattatttccagtgaaacccataaaaattaataagatattcttctgctcactctttaaaagctttctatagttcccgctcccttcactatttttacaattcacataatttgtcattattcattccgcaagatttataacctccggtgataaaatggcattcagctcgttaataagagagttaacttattaagcgttagcgtttattactgaggtaacaccatgaaaagattaattcctgtggcattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagctgctgttgctggcctgacgatggggatcatcgctctatcgaaataactgaacagggcgcggagttccgcgctctttttaacgatacagtatctctccataagataaaatattgctatattctgctgggtaattccctgctgatttagcatgttacatcgcgttatttcgctgctttcgaaataacgcatcaatttaattttcacacttcccaccagaaatatactcacgctaacaatcattattctgcttagtaaaacacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgctgctggcgcgacgcttgatgccgttcagaaaaaaggttttgtgcaatgcgggatcagtgatggattacctgggttctcttatgccgatgctgacggtaagttttcaggtattgatgttgatatttgtcgtggtgttgccgctgctgtatttggtgacgacacgaaagtgaaatataccccgctcactgcaaaagaacgcttcaccgctttacagtcaggggaggtggatttgctctcccgtaatacgacctggacttcatctcgcgatgccgggatgggaatggcatttaccggcgtcacttattacgacggcattggcttcctgacgcacgataaagcggggctaaaaagcgcgaaagaactggatggcgctaccgtctgtattcaggcgggtactgataccgaactcaacgtcgccgactacttcaaggcaaacaatatgaagtacacaccggtgactttcgatcgctctgacgaatcagcgaaggcactggaatctggtcgctgcgatacgctggcctcggatcaatcacaactgtatgccctgcgcatcaaattaagcaacccagctgaatggattgtcttaccggaagttatctcaaaagaaccgcttggtccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctataacatcatcaaacaggtgggtaactactcggaaatttttgagcgtaacgtaggttcagaaagcccgctgaaaattaaacgtgggcaaaataatctctggaataacggcggtattcagtacgcaccgcccgtgcgttaagtcggtgtgaggtaacgagcgtcgctacggcggcgctctcttcagcgttatgctttccgaggtttctatgtctcatcgccgctcaaccgttaaaggctcactctcttttgccaaccctacggttcgcgcctggttattccagatccttgccgttgttgctgttgtcggcattgttggttggttatttcacaacactgtaacgaatctcaataatcgtggcattacttcaggttttgcctttctggatcgcggcgctggcttcggtattgtccagcatttgatcgattaccagcagggcgacacctacggacgcgtttttattgtcggcttactcaatacgctactggtttctgcattgtgtattgtgttcgcttctgttttgggcttctttatcggtctggcgagactttcggataactggctgctacgaaagctttccacaatttatattgagatcttccgtaatattcccccgctgctgcaaatcttcttctggtactttgccgtgttgcgcaatttgcccggaccacgccaggctgtgagcgcgtttgatctggcctttttgagcaatcgtgggctttatattccgtcaccgcagctgggagacggatttattgcgtttatcctggctgttgttatggctatagtcctttctgttgggctattccgctttaataaaacataccagataaagaccggacaactgcgccgcacctggccgatcgccgcagtgttgatcattggtttgcctttactggcgcaatggctttttggcgcagcactacactgggatgtcccagccctacgaggctttaacttccgcggcgggatggttttaattcctgaactggcagccttaacgctggcactttcggtttatacatctgcatttatcgccgagattatccgcgctgggatccaggcagtgccttatggtcaacatgaagcggctcggtcactgggattacccaacccggttacgctacgccaggtcattattccccaggcattgcgggtgattattccaccgttaaccagccagtatctcaacatcgtcaaaaactcctctcttgccgccgctattggctatcccgatatggtttcgctgtttgccggcaccgtgctgaatcagacgggcaagccatcgagacgatagccatgaccatgtcggtctatctgattatcagcctgactatctcgctgctgatgaatatctataaccgccgcatcgcg

SEQ ID NO: 49 - protein, 311 aa, Artificial Sequence
  Description of Artificial Sequence; note = synthetic construct
MNKYLKYFSGTLVGLMLSTSAFAAAEYAVVLKTLSNPFWVDMKKGIEDEAKTLGVSVDIFASPSEGDFQSQLQLFEDLSNKNYKGIAFAPLSSVNLVMPVARAWKKGIYLVNLDEKIDMDNLKKAGGNVEAFVTTDNVAVGAKGASFIIDKLGAEGGEVAIIEGKAGNASGEARRNGATEAFKKASQIKLVASQPADWDRIKALDVATNVLQRNPNIKAIYCANDTMAMGVAQAVANAGKTGKVLVVGTDGIPEARKMVEAGQMTATVAQNPADIGATGLKLMVDAEKSGKVIPLDKAPEFKLVDSILVTQ

SEQ ID NO: 50 - DNA, 20906 bp, Artificial Sequence; identical to SEQ ID NO: 20
  Description of Artificial Sequence; note = synthetic construct

SEQ ID NO: 51 - protein, 512 aa, Artificial Sequence
  Description of Artificial Sequence; note = synthetic construct
MARAVHRSGLVALGIATALMASCAFAAKDVVVAVGSNFTTLDPYDANDTLSQAVAKSFYQGLFGLDKEMKLKNVLAESYTVSDDGITYTVKLREGIKFQDGTDFNAAAVKANLDRASDPANHLKRYNLYKNIAKTEAIDPTTVKITLKQPFSAFINILAHPATAMISPAALEKYGKEIGFYPVGTGPYELDTWNQTDFVKVKKFAGYWQPGLPKLDSITWRPVADNNTRAAMLQTGEAQFAFPIPYEQATLLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 52 - DNA, 13857 bp, Artificial Sequence
  Description of Artificial Sequence; note = synthetic construct
tctgcatcctcataaattgctgatgacgtggcggagtgccgcgtcttatcaggcctggaggtggcaattactgcccacacacctcacaccccggattacgcatcagtttcatttcgcgaaactgacaggtcatcgcatcgtacatgacgattttcccgctggccggtttgccataacctgccagcattttgatcgcttccattgcctgcaacgaaccaattacgccgatcaacggtgccattacgcctgcttccacgcaggttaatgcattttcaccaaacaaacggctaaggcagcgatagcacggttcaccgtcctgataagtaaagacggtgatttgaccttccatacgaattgccgcgccggaaaccagcggtaccttcgcggcaaaacagcctgcgttcagttgattacgtaccgcaacgttatccgtacagtcgagcaccagatcgtgttcagcaatcaatgctgcaagttctgcgtcatccagcagtgcattgactggcgtaatcgcgatatgtgggttgatccgcgtcagggcgtcacgggcggattccaccttcggttgcccgaccgtggcatcactgtgcagtgtctggcgttgcagattcgagagcgaaaccgtgtcgaagtcgagcagcgtcaggttaccgacaccggcgcttgccagatactgcgaggctgcacagccgaggccgcccaggcccactatcagcacgcgagaatctttcagcgcctcctggccgtcaaaatcaaagccgcgcagaatgatttgccggttgtagcgcagcatctcctgatcgctgagttccgccattacaggcctccgaacaacgcgttaaacggttctacttccacccattcgcccacttccacattgccgcgatcgcgttccagcacgataaagcagttgccgaggctaaaggagctaaatatatgtgaaccctgatgtccggtggtcgtcacttccagttcgccatcggcgttgcgttgcagcacgccgcgctggaaatcaagacgtcctggcgtttttttcaggcgggacgctgtgcgtacgcgctggcgcgcgggcaggccgctggcggtgttaccgcttagttttgccagcaaaggctgtaccagttgatagaaggtcagcgtcgctgaaaccgggttgcccggcaggccgcagaaccagctattgctgagtttaccgaacgcgaacggtttacctggtttaatcgccagcttccagaaggcgatctcccccagctcttcaagaatcgttttggtgtaatccgcctcacccactgaaacaccgccggaactgatcaccacatccgcctggctgtcggcttcaataaatgcggcgcgcagggcatggggatcgtcgcggataatccctaagttaattacctcgcatcccaactgttctaacatcaggtgtacggcgagacggttggtatcgtagatttggccgtcgcccagcggctgaccgggcaactggagttcatcaccggtagaaaaaagcgctacacgcactttacgaatcaccggaacttcggcaatccccagtgaagcaattactggcagctctgcggtagtcaggcgagttcccgccgggaaaacaaccgcacctgcagagatatcttcaccgcgacggcgaatattttgcccgctacgcacttcagcagtaaaacgcacgccattgtccatttgttcagtctgctcctgcatcaccaccgcttcgcagccttccggcaccggcgcaccggtcataatacgaatgcaggtacccgcaggccattcaccatggtatggctgaccggcaaaggatttaccggcaacgggcagcggttgcccggaggcaatatcggctaaacgcaccgcgtagccgtccattgcggagttatcaaaccccggaacatcaagcggcgaaacgacatcgctcgccagaatacgaccaaaacactgtaccagtggcagcgtttcctgggcggtcagtggggtgacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctgggtcctgcctttacatgccatatccatctttctatattcaaaaattgaatgagtaattcataaaaattctgatatttatagcaaaagtggcgaaccacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcgtggcatggagcgcgtctcgccggagattttctccacgtctttgcgttatgaacaactactggcagcgcgcaaggaaggggcaaccgtcctcgaccatagcggtgcgccactggatgaaaaacagaaaatgggcaccgtgggggccgtggcgttggatttagacggcaatttggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtaatgtgctggcggttgaaaatctgaatattgcctttatgcaggaccagcagaaaatagctgcggtccgcaatctctcttttagtctgcaacgcggtgagacgctggcaattgttggcgaatccggctccggtaagtcagtgactgcgttggcattgatgcgcctgttggaacaggcgggcggtttagtacagtgcgataaaatgctgttgcagcggcgcagtcgcgaagtgattgaacttagcgagcagaacgctgcacaaatgcgccatgttcgcggtgcggatatggcgatgatatttcaggagccgatgacatcgctgaacccggtatttactgtgggtgaacagattgccgaatcaattcgtctgcatcagaacgccagtcgtgaagaagcgatggtcgaggcgaagcggatgctggatcaggtacgcattcctgaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgcgatgaaagggttagattatccccgacgtttcccgttgatatcgcttgaacatccagcgaaacaggccccccccatcgagcagaaaacggtggtggatggcgaacctgttttacgagtgcgtaatcttgtcacccgtttccctttgcgcagcggtttgttgaatcgcgtaacgcgggaagtgcatgccgttgagaaagtcagttttgatctctggcctggcgaaacgctatcgctggtgggcgagtctggcagcggtaaatccactaccgggcgggcgttgctgcgcctggtcgaatcgcagggcggcgaaattatctttaacggtcagcgaatcgataccttgtcacccggcaaacttcaggcattacgccgggatattcagtttatttttcaggacccttacgcttcgctggacccacgtcagaccatcggtgattcgattatcgaaccgctgcgtgtacacggtttattgccaggtaaagacgcggctgcacgcgttgcgtggttgctggagcgcgtgggcctgttacctgaacatgcctggcgttacccgcatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggcggtggtagagcggattagtcatcgtgtggcggtgatgtatctcgggcaaattgttgaaattggtccacggcgcgcggtcttcgaaaacccgcagcatccttatacgcgtaaattactggcggcagttccggtcgctgaaccgtcccgacaacgaccgcagcgtgtactgctgtcggacgatcttcccagcaatattcatctgcgtggcgaagaggtggcagccgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaagatgtggtggtggcggtaggatcgaatttcaccacgctcgatccgtatgacgcaaatgacacgttatctcaggccgtagcgaaatcgttttaccaggggctgttcggtctggataaagagatgaaactgaaaaacgtgctggcggagagttataccgtttccgatgacggcattacttacaccgtgaaattgcgggaaggcattaaattccaggatggcaccgatttcaacgccgcggcggtgaaagcgaatctggaccgggccagcgatccggcgaatcatcttaaacgctataacctgtataagaatattgctaaaacggaagcgatcgatccgacaacggtaaagattaccctcaaacagccgttctcagcgtttattaatattcttgcccatccggcgaccgcgatgatttcaccggcagcgctggaaaaatatggcaaggagattggtttttatccggtgggaaccggaccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccttacgagcaggccacactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgtccggcgctggtgaaagttgcctttgcgggctatgcaacgccagctactggtgtggtaccgccaagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagcggactgggcactatcgccgctgtttgcctcgcagaactggccaccgacgctgtttaataccgcgttttacagcaataaacaggtggatgacttcctggctcaggcactgaaaactaatgatccggcggaaaagacccgcttatataaggcggcgcaggatatcatctggcaagaatcgccgtggatcccgctggtggtagaaaaactggtgtcggcacacagtaaaaacctgaccggtttttggatcatgccagacaccggcttcagctttgaagacgcggatttgcaataagcaacgcagggagtggaatgcttaattacgttatcaaacgcttactggggttgattccgacgctgtttatcgtctcggtgctggtgtttttatttgtccatatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggttatatttggtatggcggcgggaattatcgccgccgtctggcgtaaccgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacccgcgcgtcgtttgtcgatgttttaagcgaagattatatgcgtaccgcgagggcgaaaggggtgagcgaaacctgggttgtcctcaaacacgggctacgtaacgcgatgatcccggtagtgaccatgatgggcttacagtttggctttttgctcggtggttccatcgttgtggagaaagttttcaactggccgggacttggacgcttactcgttgactccgtagaaatgcgtgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctcgctggatattatgaaggctggtgggatcggctgatcatgcgcatttgcgatgtgctgtttgccttcccgggtattttactggcgatcgctgttgttgcggtgttgggaagcggcattgctaacgtgattattgcagtcgccattttttccatccccgcgtttgcccgcctggtgcgcggcaacacgctggtgttgaaacagcaaacctttattgagtcagcacgcagtattggtgccagcgatatgaccgttttgttgcgtcatatcctgcctgggaccgtctcttctatcgtggtgtttttcaccatgcgcattggtacctcgattatctctgccgccagcctctcatttctcggcctcggtgcgcagccgccgacaccagagtggggagcaatgctcaatgaggctcgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggacaatttttgcagcggcacagcgttcagatagttattttgttaaatgtattaacatgctgagtttatacgaaaagataaagataaggctgataattttatttttattggcagcactgtcatttattggtctttttttcatcattaactatcaactggtatcggagcgcgcggtaaaacgtgccgatagccgctttgaacttattcagaaaaacgttggctatttctttaaagatattgaacgttcggccctgacattaaaggactcactgtatttattaaaaaatacagaggagattcaacgcgccgtgattcttaaaatggaaatgatgccatttttagactcggtgggactggtacttgatgataataaatattatcttttttcgcggagggcgaatgataaaatcgttgtttatcatcaggaacaagtaaatggaccgcttgtcgacgagtcagggcgggttatttttgccgattttaacccatcgaaacgaccgtggtcggtggcttcagatgactctaacaacagctggaatccggcatacaattgctttgatcgtccgggtaaaaaatgtatctcttttacgctacacatcaacggcaaagatcacgatttgttagcggtggataaaattcatgtcgatttaaactggcgatatctgaacgagtatcttgatcaaatcagcgctaatgatgaagttctatttttgaaacaaggccatgagatcattgccaagaatcaactcgctcgtgaaaaactgattatttataatagcgaaggtaattataatattattgattctgtcgatactgaatatatcgaaaaaacatcagcggtgccaaacaacgcattattcgaaatctatttttattatcctggcggtaatttattgaacgcatcagataaacttttttatctgccgtttgcgttcattattatcgtattgctggtggtttatttaatgaccactcgtgtgttccgtcggcaattttctgaaatgacagagctggttaatacgctggcgtttttgcctgactcaacggatcaaatcgaggctctgaaaattcgtgaaggcgatgcgaaagagattatcagcatcaaaaattcgatcgcggaaatgaaagatgccgaaattgaacggtcaaataaattgctctcactgatctcttacgatcaggaaagtggttttattaaaaatatggcgattattgagtctaacaataatcagtatctggctgtggggatcatcaaactgtgtggtctggaagccgtggaagcggtgtttggtgttgatgagcgcaataaaatcgtcaggaaattgtgtcagcgaattgccgagaaatatgcgcaatgctgcgatatcgtgacattcaatgccgatctctatttacttctgtgtcgggaaaatgtacagacatttacccgtaaaatagcgatggtaaacgattttgacagcagctttggctaccgcaatctgcgcatccataagtctgccatttgtgaacctttgcagggggaaaacgcctggagttacgcagaaaaactgaaactggcgatttccagtatccgtgaccatatgttctcagagtttattttctgtgatgacgcgaaactcaacgaaatagaagagaatatctggattgcgcgtaatattcgccatgcaatggaaattggcgaactattcctcgtctatcaaccgatcgttgatattaacacccgcgccattctgggcgcggaggcgttgtgccgttgggtgtctgcggagcgggggatcatttcaccgctgaagttcattaccattgctgaagatatcgggtttatcaatgagctgggttatcagattattaaaacggcaatgggtgaattcagacattttagtcagcgtgcgtcgctgaaggatgatttcttactgcatattaatgtttcgccctggcagttaaacgaaccacactttcatgagcgttttaccaccatcatgaaagaaaatggcctgaaggcgaacagcctctgtgttgagatcactgaaaccgtgatcgagcgaattaatgaacatttttatctcaatattgaacaactgcgtaaacaaggggtacggatatcgattgatgactttggcaccggtttgtcaaacctgaaacgtttttatgaaattaatccagacagcataaaggtggactcgcaattcaccggcgatattttcggtactgcgggaaaaattgtgcgcattattttcgacctggcacgctataaccggatcccggtgattgcggaaggcgtagagagcgaagacgttgcgcgcgaattaatcaaattaggatgtgttcaggctcaggggtatctgtaccagaaacccatgccattctccgcctgggataaaagtggaaaattagtaaaagagtagtttacgtatgtccagaatcaataagttcgtacttacagtcagtctgctgatttttatcatgatttcagcagttgcctgcgggatctacactcaaatggtaaaggaacgggtgtatagcctgaaacagtccgttattgatactgcttttgcggtggcaaatattgctgaatatcggcgtagcgtggcaattgatcttatcaacacgctaaatcccacggaggaacagctgttggttggtttgcgcacagcttacgccgactcggtttccccctcttatttgtacgatgtcggtccttatctgatttccagtgacgaatgtattcaggtaaaggagttcgagaaaaattattgtgcagatattatgcaggttgtgaagtatcgacatgtcaaaaatacagggtttatctcttttgacggtaaaaccttcgtctattacctctatccggtaactcacaatcgtagtctgatatttttgcttggtctggagcgtttttctttactgtcaaaatcgctggcgatggacagcgagaacctgatgttctctctatttaagaacggtaaaccggtgaccggtgatgaatataatgctaaaaacgccatcttcaccgtttcggaagcgatggagcacttcgcctatttgccgaccggattgtatgtatttgcgtataaaaaagatgtttatttgcgggtttgtacattgattattttctttgccgcattggtggcagtgatatcgggtgccagttgcctctatctggtacgcagagtgattaatcgtggtattgtggagaaagaagccatcattaataaccattttgaacgcgtactggatggcgggcttttcttttcggctgccgatgtcaaaaaactctacagtatgtataactcggcgttcctggacgacctgaccaaagcaatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtctaccgcttcggcggtgacgaatttgcggtgatttatacgggtggaacgctggaagagttgctatcgattctaaaagaaatcgttcatttccaggtgggaagcattaatttaagtaccagtatcggtgtagcacattcaaatgaatgtcctaccgtcgaacgcttgaaaatgctggcggatgagcggctgtataagagtaagaaaaacggcagggcacagattagctggcagtaatcattattcgcaggccggacaaatgattttgcccggcctgaattaattaaacccggctaccccacaaatcgtactcatcggcgtgctcgactttcacacgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatctgctgctgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactgtttgatgcgcgccagttggcgatctacagaacccggacgcttcatcagtttgagaatgcgcgggctggcgtgctgcaacggaatgtccagatacggcaggattttgccttctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcaacgccataggcggaagtatcctgcgagatcaccagaatctctttaacgcccgcatctaccagacgtttcgcttcacttaacacttcgccaatcggacggctcaccaggtcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaataaccttgccgttttcattcaacgcttcaccaatggcttccagtgattcttgtaccgcgctgtcaataaagccgcaggtgttgacgatcaccatgtccgcatcgtcatagctcggtaccacgtcataaccttcagtgcggagttcggtgagaatacgctctgaatcaacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggaggcgaaggaaatgtaaattttgttaattcggcgtgaagaat

SEQ ID NO: 53 - protein, 340 aa, Artificial Sequence
  Description of Artificial Sequence; note = synthetic construct
MTLHRFKKIALLSALGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIKGVGQVEVSPNSVQGYDYEADGNGIVLLPERVIFNKENIGKYDF

SEQ ID NO: 54 - DNA, 10603 bp, Artificial Sequence
  Description of Artificial Sequence; note = synthetic construct
ctcggcttatgcgttctgtctgttcctctatacgttctccatcattcccggtaataaggtcatgcaaatttaactacgtaaaatcgccgctgctgtgtcctgatcggtaaccagtgcgttgatataaccgcctttcattgcagcggcaattgcttcggctttattttctccccctgccacgccaacccggacgggtatggtcttcagcgcgcttaaaggtaagccaatcagttcgttatgtattttgatattcgtgacaacgtcaccttttgcatcaaaaaagtagcctaaaatgtcgccaaccgccccttttcggccaatcattaactgttcgccctggctgatataaccggagcgaatgattgtcgcatcgtcctgttgactcacagcaccaatgccgacaatcgccacatccgctgcttgcgcggctaacagaacatctttgacgcaattttcattttttagcgtacgggcaatgtcagcggaggatgcccgcaacggagccggaataatattcacactgcacgccgcgttaagctgcccgattcccgtcatataagaaccgacgccaccggagagcgtgaccaggcgaatttgctgtgacgaaataaaaccacttaagcgttgcagcgtattcatggttgcctcgccaaaaccaatcgccagcatctgttgtggttgaagtaaactcatcaacatatgcgccgcgcctatccccagtcgcccaccgacatcagcatccgcaagcccagggatcacccggacatgttgcagcgaaaactgacgacgtaattgagtttcatattccagacagccttcaaagcgagaattaatctgtacgcgaataatgccggactgatgccctttctccagcaatcgcgacactttcaaacgtgtcaggccgagacgatcgctgatctcgctctgggtcagcccgtcgtgatagtaaaaccacgcgatccgcgcgacctgttcttcttcacacattccctgttctgaaattgccgaatcgttgattgtcataattcattcttcactttgaacatatttaaatctttaatgcaattgttcagttcttgctcatttatatctgtgatggcaaccacagtttgactctacgagcatgaacaaacgcaaccgtgaaaatcaaaatagcataaattgtgatctattcgtcggaaatatgtgcaatgtccacctaaggttatgaacaaattaaaagcagaaatacatttgttcaaaactcacctgcaaaactgaacgggggaaatatgcaaacgagtgatacccgcgcgttaccgctactttgcgcccgctcggtttataaacagtattcaggggtcaatgtcctgaaaggcatcgattttacgttgcatcagggggaggtccacgccctgctcggcggcaatggtgccggtaaatcgacgttaatgaagattattgccggtattacccctgctgatagcggtacgctggagattgagggcaacaactacgtcagattaacgccagttcatgctcatcagctgggtatttatctcgttccccaggaaccgctgcttttcccaagcctgtcgataaaagaaaacatcctgtttgggctggcaaaaaaacagctctccatgcagaaaatgaagaacttgctggcggcgctgggctgccagtttgatctgcatagtctggcaggatcgctggatgtcgccgatcgccaaatggtggaaatcctccgcgggctgatgcgcgactcgcggattctgatcctcgatgaacctaccgcctcgcttacccctgcggaaaccgaacgcttgtttagtcgcttgcaagagctgcttgctactggcgtgggtattgtttttatctcgcataagctgccggaaattcgccagattgccgatcgaattagcgtgatgcgcgacggaaccatcgccttaagcggcaaaaccagcgaactgtctaccgacgacattattcaggccatcaccccagcggtacgggaaaaatcgctctctgccagccaaaaattatggctggagttacctggtaaccgcccacaacatgccgccggaacgccggtgctgacactggaaaatctgaccggcgaaggtttcaggaatgtcagcctgacgctcaatgccggagaaattctgggcctggctgggctggtgggggccggacgcacagaactggccgagacgctctatggtctgcgtactttgcgtggcggacgcattatgctgaatggtaaagagatcaataaattatccactggagaacgtttactgcgcggtctggtttatctgccggaagatcgccagtcatccggactgaatctcgatgcttcgctggcctggaacgtctgcgcccttactcataaccttcgtggattctgggcgaaaaccgcgaaagataatgccaccctggaacgttatcgtcgggcgctgaatattaaattcaaccaaccggaacaagctgcacggacattatccggtggcaaccagcaaaaaatcctcattgccaaatgcttggaagcttcgccgcaagtattgattgtcgatgagccgacgcgcggcgtggatgtctcggcccgtaatgatatctaccagctgttgcgcagcatcgccgcacaaaatgtggctgtgctgcttatctcctccgacctggaagagatcgaactgatggcagatcgtgtgtatgtgatgcatcagggcgaaattacccactctgcactgaccgagcgcgatattaatgtcgagactattatgcgcgttgccttcggcgatagtcagcgtcaggaggcgtcatgctgaagtttattcagaacaaccgtgaaatcacggcactgctggcggtggtgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcttgtgtcgcgactttactgcttggtttgctcgcgggatttttcaacggtgtcctggtcgcgtggctaaagatccctgccattgttgccacccttggcacgttagggttgtacagaggcatcatgttgctgtggactggcggcaaatggattgaagggttacccgccgaactgaaacagctctccgccccgctgctgcttggcgtttcagcaattggttggttgacgataattctggtggcatttatggcctggctgctggcaaagacggcgtttggacgcagtttttatgccacgggcgataatttacagggcgctcgtcaactgggcgttcgtactgaagccattcgcattgtggcattttcgttgaacggctgcatggcggcactggcgggaattgtgtttgcttcgcagattggttttatccccaaccagaccggtaccgggctggagatgaaagcaattgcagcctgcgtgctgggcggcattagtttgctcggtggttccggtgcgatcattggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacgtaatctacggcggcaaaaatatgcccgctttatgacgccaccgccatccgttaaacccgcttcgtcaggtaaaaaacgggaggccgcataatgcgtattcgctacggttgggaactggctcttgccgcactgctcgttattgagattgtcgcatttggtgcaattaacccgcgaatgttagatctcaatatgttgctgttcagcaccagtgactttatctgcattggcattgtcgccctaccgctaacgatggtgattgtcagtggcgggatcgatatttcgtttggttcgaccatcggcctctgcgccattgcattgggcgtactgtttcaaagtggtgtgccgatgccgctggcgatactcctgaccttactgctcggcgcattgtgcgggctgatcaacgccggattaattatctataccaaagttaacccgctggtgattacgcttggcacgctgtatctgtttgccggaagcgctctgctgctttccggtatggccggagcgacggggtacgaaggtattggtggattcccgatggcgtttacagatttcgctaacctggatgtgctgggactccccgttccgctgattatcttcctgatatgtctcctcgttttctggctctggctgcataaaacccatgccggacgtaatgtgtttttgattgggcaaagcccgcgcgtggcgctttatagcgcgattccagttaaccgtaccttatgtgcgctctatgccatgacggggctggcgtctgcggtcgccgctgtgctgctggtatcgtattttggttcagcacgttccgatctcggtgcgtcgtttctgatgcccgccatcaccgccgtggtgcttggcggggccaatatttatggtggttccggttccattatcggcaccgccattgcggttttattagtgggatatttgcaacaaggtttgcaaatggcaggagtgccaaatcaggtgtccagcgccctttccggtgcgctacttatcgtcgttgtcgtaggtcgttccgttagcctgcatcgccagcaaattaaagagtggctggcgcgtcgggccaataacccattgccataaaggatatcttcatgacacttcatcgctttaagaaaatcgccttacttagcgctcttggcattgccgcaatctctatgaatgtgcaggccgcagagcgtattgcatttattcccaaactggttggcgtgggattttttaccagcggtggcaacggcgcacaacaagcgggtaaagagctgggcgttgatgtgacctacgacgggccgacagaacccagtgtttctggtcaggtacagttgattaataacttcgtcaatcaaggttataacgccattatcgtttctgcggtttcgcctgatggcttgtgtccggcactgaaacgcgccatgcaacgtggtgtgagagtgctgacctgggactctgatactaaaccggagtgccgctcttactacattaatcagggaacgcccgcccagttaggaggtatgttggtggatatggcggcgcgtcaggtgaataaagacaaagccaaagtcgcgtttttctactcaagccccaccgttacggaccaaaaccagtgggtgaaagaagcgaaagcgaaaatcgccaaagagcatccaggctgggaaattgtcactacgcagtttggctataacgatgccactaaatcgttacaaaccgcagaaggaatattaaaagcgtatagcgatctcgacgccattatcgcccccgatgccaacgccctgcccgctgccgcacaagccgcagaaaacttgaaaaatgacaaagtagcgattgtcggattcagtacgccaaatgtgatgcgcccgtatgtagagcgcggcacggtgaaagaatttggcctgtgggatgtggttcagcaaggcaaaatttcagtgtatgtcgcggatgcattattgaaaaaaggatcaatgaaaacgggcgacaagctggatatcaagggcgtaggtcaggttgaagtctcgccaaacagcgttcagggctatgactacgaagcggatggtaatggcatcgtactgttaccggagcgcgtgatattcaacaaagagaatatcggcaaatacgatttctgatgtgcattacttaaccggagtaagttatggcagatttagacgatattaaagatggtaaagattttcgtaccgatcaaccgcaaaaaaatatcccttttaccctgaaaggttgcggtgcgctggattggggaatgcagtcacgcttatcgcggatatttaatccgaaaacgggtaaaaccgtgatgctggcttttgaccatggttattttcagggaccgactaccggacttgaacgcattgatataaatatcgccccgctgtttgaacatgccgatgtattaatgtgtacgcgcggcattttgcgcagcgtagttccccctgcgaccaataggccggtggtactgcgggcgtcaggtgcgaactctattctggcggaattaagtaatgaagccgtggcgttatcgatggatgacgccgtgcgcctgaacagttgcgcggtggcggcgcaggtttatatcggcagcgaatatgaacatcagtcgatcaaaaatattattcagctggttgatgccggaatgaaagtgggaatgccgaccatggccgtgactggcgtgggcaaagatatggtgcgcgatcagcgttatttctcgctcgcgactcgaatcgccgctgaaatgggggcgcaaattatcaaaacctattatgtcgaaaaaggttttgaacggattgttgccggatgtccggtacccattgttattgctggcggtaaaaaattaccggagcgcgaggcgctggaaatgtgctggcaggctatcgatcagggcgcttctggtgtggatatggggcgtaatattttccagtctgaccatccggtggcgatgatgaaagccgtacaggcggtggttcaccataacgaaacggctgatcgggcatatgaactctatctgagtgaaaaacagtaactgcggatctaaggagaagaattatgcacgtcacactggttgaaattaacgttcatgaagacaaggttgacgagtttatcgaagtttttcgccagaaccacctgggctctgtacaggaagaaggcaatttgcgcttcgatgtcttacaggacccggaagtgaattcgcgcttttatatctacgaagcctataaagatgaagacgcagtggcgttccataaaaccacgccccactacaaaacctgtgtcgcgaaactggaatctttaatgaccgggccgcgtaaaaaacgtctgttcaatggtttgatgccgtgaggcgaatttatcaattttatctacaattggggtaacgcgctgacgggagtaaaaaaatgtctgactggaacccctctttatatctacacttttccgctgaacgatcgcgtccggcggtggagctgcttgccagagtgccgctggaaaatgtcgaatatgttgccgatcttggctgtggcccaggtaacagcaccgcccttctacaacaacgttggcctgcggccaggataacaggcatcgactcgtctccggcgatgattgctgaagcgcgcagtgctttgccagactgccagttcgtggaagcagacatccgcaactggcaaccggtacaggcactcgatctgatttttgctaatgcctcactgcaatggctgcccgaccactacgaattgtttcctcatctggtttctttacttaatccgcagggcgtgctggcagtacagatgccagataactggctggagccgacccatgtgctcatgcgcgaagttgcctgggaacaaaactacccggatcgcgggcgtgagccgttggctggcgttcatgcttactacgatattttgagcgaagccggatgtgaggtcgatatctggcgaaccacctactatcaccagatgccgtcacaccaggcgattatcgattgggtgactgccactggattacgtccgtggttacaggatctgaccgagagcgaacagcagctttttcttaagcgctaccatcagatgctggaagagcagtatccactgcaagagaacggacagatactgctggcatttccgcgtctgtttattgttgcccggcgtatggagtaaatatcacgtcagctggtaatgacgatcgggaagaatttttgctggaatttcggcttcatcgttcatctgtaacaggtcaatttcaatagcgttgcagatggcatccagtggtaaatcattgttttcagtaccgaacggatcttccagttcttccgccagacaatccagcgaaataaaagtgtaggaaatcagcacagagataaaaggcgtcatgtaatgcaggtccacgaccagcgcgaacggcagcatgatacaaaacagataaacggtacgatgcaaaatcagggtgtaggcaaagggaattggcgtataggcaatgcgctcgcatcctgccaggaccgctgaaatatcattaagccgatcgttgaggctaataaacaggatatctgaaagctgtccattgcggcgctgaaccgccaaccattctcccattattaacaagatacggttagctggagagttcgaagccagtacacgctgaagatcttcagtcttgagataatgagccagcacttccgcctgtggctgtttgcgtaatgtcatgcgtaaacagtgggcgaaagcgatttgcagccgggcaaactcccttacacttgccgaatccggcaatgtcgtttttacctcgcgcagtaacgaccgtgaggcaatcatcaactgcccccaaagttttcgcgcttcaacgtaacgggcgtacccggcattattacgaaaaccaagaaaaatggcgatggcgacaccgagaatgctgaacggtgcgagggtgaatttgatgcccagatgcgtgtaccagggcagcatgaaaataacagcgatagaaaagagaaaattgagtagtaagcgcgaggatatcttggataatactgagccgtgccagacaaaaatacggcgcagccagtgttgttgtggacgaacaatcatggttatcttcaggcgtggaaaagtcgccctattaaacgtgattacgatcacattctcaagacgctacttacaaattacctacaagcttacaacattagcaggcgctgcatgtggcacctgttaatgataaaggcatataggatgttgtaactaatatggtgaaataagaaacccggtcgaaaccgggttcagaagtaacggtgttattagcacaacggacgtacagcttcgcgcatccctttttcgagaatcgcatccaggtcattagcaacctgctcgaccagaccaggcacttgcgtcaggtcctgctcccagtggtctttttctgccaaaacaatcgctaccagttcctgggtgccgataacacggtcacgatgctggctccagagttgctgataacgttccagccagtgtgcatcgtcctgtaccggatatgtttcgccgttacgctcaccacgatagaacgcaatcaatgccgctaatgcgaaagtaaggcgcgccggaagtgtgccgtttgccttctgccctgccagcagctgtggcaggatgcgggtgcggaacttggtcataccgttgagcgcgatagacagcagctgatgcttaatgtacgggttacggaaacgcccggtgactgcactggcgaaagattccagttcatcacgaagcaaatccagtaccggaataatttcttcgtagatagctttttcaacgaatgcgcaaatttcagcatcgttcatcgcttcacctacggtatccagccctgcctggaacgccaccggcaccagcgcggtgtgcgcaccgttgaggattgccactttgcgttctttgtacggtttaatatcgtcaacaatcagcacgttgagcggatatttgtccagacgcagttcagtcgctaaggatttcggtccctgaatcacaaacaggtaaaagtgttcagcggtgtcgagaaaaccatcgtgataacccagttcttcttccagtttagccacttcatcgcgcggataaccggtaacgatacggtccaccagcgtagaacagaagctgttagcctgatccagccattgaataaatgcttctggcagtgcccactcttgcgcatagcgcagcaccagttcacgcaacgcgtcgccattgtagtcaatcaactcacacggaatgatgatccaacctttatccagcgcaccgttgaaatggctaaagcgttcgaacagcagacgggtcagttttgccggatagcttaccgctggcgcgtcatcgaatttatcgcccgcatggtagctgatacccgcttcggtggtgttagagaaaacaaagcgcatttccgggttgtgcgccagtttcaggaattcatcgtattcactgtagacgctgatttcacgattaaccgagcgaatcagacgcgcgtcgctgaccgcttcccccttctcattcaggccacggataatggtggtgtacagaccatcctgcgtgctcagtgacggcgggaatgaagtttcaatcggacgaacaacgaccacgccagaattcagatcggtgtgctcattcaggagatcgatttgccagtcaacaaaggcgcgcaggaagttaccttcaccaaactgaatgatacgttctggatactgtgcaccgggaaaatcgcgacgatttagtgttttcacaatgggttcccttctgattagtcatacaacctgtttgaattggtacgacaggttagcaaactttaatacgccgaacccctgttttgatcaactcctgatgattaatgagcagttttatgagaaaagtgtggcgcggatcat

SEQ ID NO: 55 - protein, 327 aa, Artificial Sequence
  Description of Artificial Sequence; note = synthetic construct
MPTKMRTTRNLLLMATLLGSALFARAAEKEMTIGAIYLDTQGYYAGVRQGVQDAAKDSSVQVQLIETNAQGDISKESTFVDTLVARNVDAIILSAVSENGSSRTVRRASEAGIPVICYNTCINQKGVDKYVSAYLVGDPLEFGKKLGNAAADYFIANKIDQPKIAVINCEAFEVCVQRRKGFEEVLKSRVPGAQIVANQEGTVLDKAISVGEKLIISTPDLNAIMGESGGATLGAVKAVRNQNQAGKIAVFGSDMTTEIAQELENNQVLKAVVDISGKKMGNAVFAQTLKVINKQADGEKVIQVPIDLYTKTEDGKQWLATHVDGLP

SEQ ID NO: 56 - DNA, 15169 bp, Artificial Sequence
  Description of Artificial Sequence; note = synthetic construct
ccctcgcctttcaggcgctattccgaaatacttcctcactgctttactttctttcgtcactctcccaccatctttccccgattaatggatgataaagaagtcgcaaggaaaggttatggcactgccagtgaacaaacgcgttcccaaaattctgtttattctctttgttgttgccttctgcgtttatttagtgccgcgcgttgccatcaacttcttctattatcccgacgataaaatttacggtcccgatccctggtcggcggaatccgtcgaatttacggctaaggacggtactcgtctgcaaggctggtttatcccttcttcgacgggccctgctgacaacgccatcgcaaccatcattcatgctcacggcaatgccggaaatatgtccgcccactggccgctggtcagttggttacccgagcgtaatttcaacgtttttatgtttgattatcgcgggtttggtaaatcaaaaggcacgccgtcccaggccggattgctggacgatacgcaaagtgccatcaatgtggtgcgccatcgcagtgatgtaaacccacaacgtctggtgctgttcgggcagagtattggcggggcgaatattctggatgttattggtcggggtgatcgtgaaggcatacgtgcggtgatcctcgactccacatttgcctcttatgcaaccatcgccaaccaaatgatccccggcagtggctacttacttgatgagagttacagcggcgaaaattatatcgccagcgtcagcccgatcccgcttttactcattcacggtaaagctgatcacgttatcccatggcagcacagcgaaaagttgtatagcctggcaaaagagccaaaacggttgatcctaatcccggatggcgaacacattgatgctttttccgatcgtcacggcgatgtttatcgcgaacagatggtggactttatccttagcgcgttgaatccgcagaactaacccatgatcgctagcacgataatcattcacaaaaccaccttaagacatgctaatccactggtcagaacagtttaagatgagaaaaattctgtgacgcttgccaacatttctgatgattagcattcccttcgccatttccttgagcaaactttagctattcttatcaattatgcttatgggagatctacagatgatgcctacgcttgctccaccatctgtcctttcggctccccagcgccgctgccagatcttgctgacgctctttcagccggggttgaccgccaccatggcaaccttcagcgagcttaatggtgtggatgatgatattgccagtcttgatatcagcgaaacaggacgggagatcctgcgctatcatcaactcacactgacgactggttatgacggtagctaccgggttgaaggtacagtgcttaaccaacgtttgtgtttatttcactggctacgacgtggtttccgtctgtgtccgtcatttattaccagccaattcacccccgccctgaagagtgaactgaagcggcgcggaattgcgcgtaacttttacgacgataccaatctacaagcgttagtgaatctctgctcccgacggctgcaaaaacgctttgaatcgcgcgatattcatttcctgtgtctgtatctgcaatattgtttgctgcagcaccacgctggaattacgcctcagtttaatccgctccaacgtcgctgggcggaatcctgccttgaatttcaggtagcgcaggaaattggacgccactggcagcgtcgggcgctccagcctgtaccacctgatgagccactgtttatggcactacttttttccatgttgcgggttcccgatccattgcgggatgcgcatcagcgggacagacaattgcgtcagtctatcaaacgtctggtaaaccattttcgtgagctgggaaatgttcgtttttatgatgaacaggggttatgtgatcagctttatacccacctcgcccaggcgttaaatcgcagtttgtttgccatcggtattgataataccctgccggaagagttcgccagactgtacccacgcctggtgcgcaccacccgcgcggcgctggccggatttgaaagtgaatacggcgtccatctttctgatgaggaaagtggtctggtcgcggtgattttcggtgcctggctaatgcaggaaaacgatctgcatgaaaaacagattattcttcttaccgggaatgatagcgagcgagaagcgcagattgagcagcagttacgcgaactaacgttactgccgctcaacattaagcatatgtcggtaaaggcatttttgcagacaggcgctccgcgtggcgcggcactgattattgcgccttataccatgccattaccgctcttttcaccaccgctgatctatacggacctgacgctgacaacacatcaacaggagcagatccgcaaaatgctcgaatcagcatgagggaacaactttcgggcgcaaaaacattgccggaagcgccaccagcgccattacccagaacacgccgtggcccagatattgatacaggaaaccggcgaaaacggtcatgatagcgatactgccgcccatcgcgacggcagagtaaaccgcctgtaaacggatgacttcgctaccctggcgagcagcaatataacgcatggcggccaggtggcagaccgtgaaggtgccgcaatgcagaatttgcaccactatcaaccacggcaacgccgtagttgctcccataatgccccagcgcactacgccgcaaatcgccgagatcaacagcatatcgcgtgcactacaacggcggaaaagtttattactcagcgcaaagataatgacttccgccaccacgcccagcgaccacaaataccccaccgccgaggccgagtagccagctgcctgccagtaaatggcgctaaaaccgtaataggccgcatgtgccccctgcaataaacaaacgcaggccagaaagcgccagttctggcgaaccagcgccaaccacgcagaccaaccggtgctctcctgctggcgacttgccccttgtggctgaatcgtcggacggatgagaaagccgagcagcatggatgccacgcccaacgtcaacagcgcgaggatcacccgataatcaaacatagtgaccagtttgcccgtcagcgccgagccaatgacaaacgccaccgagccccacagtcgcactttgccgtaatcaagcgggaactgcttttgccacgtattcgccagtgcatcggtcaacggtaccagtggtgagaaaaagaggttaaagccaatcatcaccagcatcagccacgctacgtgcgcccccgcccagaaggcgacagcaaagagaagtgtcagcagtgccagcacgcgcaaggcggaaatcaggcgggaaggatcgctgacgcggggcgcgatgagcaaactcccgaggaaacgggcaaccagacctgcccccaataacaggccgatggtttctggcgttaaaccaatccctttaagccagacgctccagaaaggtagaaaaatgccgtaactaaaaaagtatgtgaaatagccgagcgccaaccagcgcgtggattgcaaaaccatgagtccctcccgtcaggaggcgttagtctggggttaatcgaatgttggtgcaagttgaaaaataagaatattcgagcctgcttcccgatgtctgtaacgccagttcacaagcactaaaaaactgagatccgcgacgcatgttgcaaaaataatgcgtaattatgccgttacgcttgccaaacgttcctgcacaatggcgatgaaatcgcgtaatgccggcttcatctcccctttcttccacgccatcagtaaagcaatggaaggcacatttccggcaatgggacgaaaaacaacctgtccggtattaaaattattcatataaccgggtatcaaagtgacgcccagccccatgcccaccagattcatggtcaccagaatattcgttgccacctggacgatatttggctggctgttttcttgcgcaaaccacgctttaacgatcggcgcaagcgaaccggaatacaccggatcggtactgacgaaattcacgccatccagttgcgcggcggtgatctctttttcatgtgctaaagggtgatcaaccggtaacacaaccactaatggttcgtcaaaaagctccagataatcaatctccgggctataaacaggatggcgcattaagccgacgtcgagttcaccacggcgaattttttcctcctgttgcgtggtgattaaactcaccagctcaatcaaggtgtctggctgtctgagacgaaacatcggtaatacttttggcagtaaattcacttccgccgatggcacaaagccaatggttaattgtctgtcttcctgaacaattttccgcgcccgtaatttggcattttccgcttgttcgaggattgccagcgcgtcctggagaaaacattctcccgccgccgtcaacgcgactttgcgcttatccctcaccagtaacggaacaccgacacagttttcaagatcgcggatctggctgcttaacgaaggctgtgaggtatgcagtttttccgccgcacgggtaaagttcagtgcctgcgccactgcgacgaaatagcgtaaatgccgtagttccatcaccttccccttgttatcgaaaaaacgtctcagctggtagaaattaactatttcacatattagcaaccaaccagcaacatccttatggcacaaaaatagaaggtcaatacatcttatctttcaggattaaaaaatatgaccacaccctcagatttgaacatttaccaactgattgacacccaaaatggtcgggtcactccgcgtatttataccgacccggatatttaccaactggagcttgagcgtattttcggtcgttgctggctatttctcgcccacgaaagccagatcccaaaacccggtgatttctttaacacctacatgggagaagatgcggttgtcgtagtgcgtcagaaagacggcagcatcaaggcgtttctcaaccaatgccgccaccgggccatgcgtgtgagttatgcagattgcggcaacactcgcgcctttacctgcccgtatcacggctggtcttatggcattaacggcgagttgatcgatgtaccgctggaacctcgcgcctacccacaagggttgtgtaaatcccactggggactaaacgaagttccttgtgtggagagttataaagggctaatttttggcaactgggataccagcgcaccgggcctgcgtgattacctgggtgacattgcctggtatctggatggcatgctggatcgtcgcgaaggcggcaccgaaattgtcggcggcgtacaaaagtgggtgatcaactgtaactggaaattcccggcagagcagttcgccagtgaccagtatcatgctctgttcagccatgcttctgccgttcaggtattaggggcgaaagatgatggcagcgataagcgcctcggtgatggacaaaccgcccgcccggtgtgggaaaccgccaaagatgcgctgcaatttggtcaggacggtcacggtagcggtttcttctttactgaaaaaccggatgctaatgtctgggtcgatggcgcagtttcaagctattaccgcgaaacctatgccgaagcagaacaacgtttaggtgaagttcgcgccctgcgcctggcgggtcataacaatattttccccacgctttcatggctaaacggcactgccacactccgcgtctggcatccgcgcggccctgatcaagttgaagtgtgggcgttctgtattactgacaaagccgcctccgatgaagttaaagccgcttttgaaaacagcgccactcgtgcttttggtcctgctggttttctcgagcaggatgactcggagaactggtgtgaaatccagaaattgcttaaaggccaccgcgcccgcaacagcaaactgtgtctggaaatggggcttggtcaggaaaagcgccgcgacgacggcattcctggcattactaactatatcttttcagaaactgccgctcgtggaatgtaccaacgctgggccgatcttctgagtagcgaaagctggcaggaagtgctcgataaaaccgccgcttaccagcaggaggtgatgaaatgagtgcgcaagtttcactagagttacatcaccgcattagccagtttctctttcacgaagccagcttactggacgactggaaatttcgtgactggctggcgcagctcgacgaagagattcgttacaccatgcgcaccacagttaacgcgcaaacacgcgaccgccgcaaaggcgtccagccaccgacaacctggatttttaatgacaccaaagaccagctggagcggcgaatcgcccgtctggaaacgggcatggcctgggcagaagagccgccgtcacgcacccgtcacttaatcagcaactgccagataagcgaaaccgacatcccaaacgtatttgctgtgcgggtaaattatctgctttatcgggcacaaaaagagcgcgatgaaacattctatgttggaacgcgtttcgacaaagttcgccgtctggaagatgacaactggcgcttgctggaacgggatatcgtcctggatcaagcggtaatcacttcccataacctgagtgtactgttctgatgaatcgaatttatgcgtgtcccgttgcggatgtgccggagggtgaggctctccggatcgatacctcgcccgtcatcgccctgttcaacgttggcggcgagttttatgccattaacgatcgttgcagccatggtaatgcgtcaatgtcagaagggtatctggaagatgacgccacggtggagtgcccgctacacgccgccagtttttgcctgaaaacggggaaagcgttatgcctgcccgccaccgatccgctcaccacttatccagtacacgttgaaggtggtgacattttcatcgacttaccggaggcgcagccatgagcgatctgcataacgagtccatttttattaccggcggcggatcgggattagggctggcgctggtcgagcgatttatcgaagaaggcgcgcaggttgccacgctggaactgtcggcggcaaaagtcgccagtctgcgtcagcgatttggcgaacatattctggcggtggaaggtaacgtgacctgttatgccgattatcaacgcgcggtcgatcagatcctgactcgttccggcaagctggattgttttatcggcaatgcaggcatctgggatcacaatgcctcactggttaatactcccgcagagacgctcgaaaccggcttccacgagctgtttaacgtcaatgttctcggttacctgctgggcgcaaaagcctgcgctccggcgttaatcgccagtgaaggcagcatgattttcacactgtcaaatgccgcctggtatcctggcggcggtggcccgctgtacaccgccagtaaacatgccgcaaccggacttattcgccaactggcttatgaactggcaccgaaagtgcgggtgaatggcgtcggcccgtgtggtatggccagcgacctgcgcggcccacaggcgctcgggcaaagtgaaacctcgataatgcagtctctgacgccggagaaaattgccgccattttaccgctgcaatttttcccgcaaccggcggattttacggggccgtatgtgatgttgacatcgcggcgcaataatcgcgcattaagcggtgtgatgatcaacgctgatgcgggtttagcgattcgcggcattcgccacgtagcggctgggctggatctttaaggaagcacgatgaaagaaaaaacgatcattattgtcggtggcgggcaagcggcggcaatggctgcggcctcgctacgccagcaagggttcaccggtgagctgcatctgttttccgatgagcgacatcttccttatgaacgacctccactctcgaaatccatgttgctggaagattccccgcagttacagcaggtgttacccgctaactggtggcaggaaaacaatgttcatctgcattccggtgtaaccatcaaaacgctgggtcgcgacacacgagagttagtgttaaccaacggcgaaagctggcactgggatcagctttttatagcaaccggcgcggcagctcgaccgctgccgttgcttgatgcactgggagaacgctgctttaccctacgccatgccggtgatgccgccagactgcgagaagttctgcagcccgaacggtcagtcgtgattatcggtgccggaactattggtctggaactggctgccagcgccacgcagcgcagatgtaaggtgacagtgattgaactggcggcaaccgtcatgggccgtaatgcaccaccgcccgtgcaacgctatcttttacagcgccaccagcaggctggtgtgcgcattctgctcaataatgccattgaacatgtggtcgatggtgaaaaagtagaactgacgctgcaaagtggggaaacgcttcaggctgatgtggtgatttacggtattggtatcagcgccaacgagcaactggctcgcgaggccaaccttgatactgccaatggcattgtcattgatgaggcttgccgcacctgcgatcccgcgatctttgccggtggcgatgtggcaatcactcgtcttgataatggtgcactacaccgctgcgaaagctgggaaaacgccaataaccaggcgcaaattgccgctgccgcaatgttagggctaccgctaccgctactgccgccgccgtggttctggagcgatcagtacagtgataacttacagtttattggcgatatgcgtggcgatgactggctttgtcgtggcaacccggaaactcagaaggcgatttggtttaatctgcaaaacggcgtgcttatcggtgcggtcacgctgaatcaggggcgtgagattcgcccaattcgcaaatggatccagagcggcaaaacgtttgatgcgaaactgctgatagatgagaacatcgcgcttaaatcactgtaaccaggataattagcgaatatctcaatgcctggggcgtggcgaggtgcaagagtgtgtattacgtttaaatcacattatcttgcaaagggattggttatgaacacactacgttattttgattttggagctgcccgccccgttttgttattaattgcccgtatcgccgtggtcttaattttcattatttttggttttcccaaaatgatgggctttgacggtacggtccaatatatggcctcgttgggcgcgccaatgccgatgctggcagcgattattgcggtagttatggaagtgcccgccgcgatattaatcgtgcttggctttttcacccgtccgctggcggtgctgtttattttctacacgctgggtacggcggtgattggtcaccattactgggatatgaccggcgatgcggttgggccaaatatgattaatttctggaagaatgtcagtatcgctggcgcgttcttgctattggcaattaccgggccgggggcaatttctctcgatcggcgttaggaaagatgccggatgcggcgtgaacgccttatccggcatttaataaattacagccactctacccgcaacgacatctctgaagttgttgattcccctggtgctagcgcaatgagatcacccccttccgggcgatgatgatcatccggcgcatggctcatcggttccagacagaagaaatcaaacgcatatcctttatcaaacgcagggtcggaaacaaagatgaaataacacggtgcaggtggcgtcgtttccatgatgatggcataaccttcctgcggctgctcgatgcgggcctgaccattccatccggcaaaaccattgttcacccactggcgcggcaacggcgcgggctggttaaaatccagttcctgcggtagctgctcgcaaaactcacccgccagccactgctcccgctccagccagtaaccgctcgcctgtgcctgaatccgcgtttgcggcgacaacggaaaataaggatgccagccggtaccaaatggcagcgtctctgccccttgattggtgacagagagcgtcaccgtcagcgtatccgccgttaaatgaaacgcctgacttacccgatagtgatagacaccgctgcgatgttcatacaccagacacaaactatcatcgctgtgcgagacacattgccactcgcccagccagccatcgccgtgtagatagtgcgcatcccactcaacattcggttgcagttgatactcacgcccctgccagacaaaacgattgccgctcacccggtttgcaaatggcaccagcggaaaacatgaggcatcggttgccacaccgctttttttaccaggacgtaagagcggcgtcgtatcgcgccagaagccttcgattacgccgccctggtcagaaacgtccagctttagcgacccgtgggataaggtatagatggtcatccgctaactccttaatccgggaagttaatcacaactttcccgcatttgccgctcgccatcagcgcataggcatcacctgcctgttccagcgagaagcgatgggtaatggcgttacgcggccacagcttccagtccgtcagatcatgggcgcatttttccatatggaacagactggtcacccaggagccgataatccgccgttgatggtgcatcagatcggcgctgacctcgaattccacttttccggtttcaccaatgtaaaccacccgtccccagtcagcggtggattgcagtgccagcaagcgacctgcggcattaccggaacaatcgagcgcaacatccgcgccaccgtgggtgagttcggcgataatctgcggcagaccttcggtggttgctaaatagccgtgatccatcacccctaactgttttgccatcgccagacgttccggcagcatatcaacgccgatgatccgttttgcaccgcgacctttcgccagcatcatcgccatcatgccgactggccccagaccgaccaccagcacgttatcactgccggaaacttcgccgcgcaaaattccttcatacgctgtaccaacgccgcaactgataaacgcaccatcttcgtagctcagcgcatccggcaggaggatcagatctttttcttccgccagcaagtattcggcatgaccgccgtcacgctgccagccgtaagccgcttttccttcgccagtacaagaaataggaaaaccgcgacggcagttcgggcaaaaaccacagccagaaatgtgatacaccagcacgcggtcgccctctttaaaatggcggcagccttgccccatcgccacaatctgcccgcacggttcatgaccgttgataaagccctggtataacggtttatcgggtgccgccgctgtggcacggtgttgatgatagatatagtggacatcgcttccgcaaatcccggaggatttcattttgatcagtacctggttaatccccggcgtcggcaccgcaacttcccgcagatcgacggtcgaatttcctggtaaataagctgccagcatcgttttcataaatccctcattaacaatacgattaattttcatccctgccgcacccgcgccaggggcgttaaggtttagcgtttcgctttactgcttcgctgggtcagcaagatattcgccagcaccgccaccacgatgatgacgccgcgtaccacctgctggaaaaaggagttaataccgagcagcaccagaccgttaccgattagcgtaatcaccagcacaccaagcaatgtaccgaacagggaaccgcgaccgccggaaagtgccgtaccgccgaccacgaccgcggcgatgacgtcaaactccagaccgtttgcggcacctgcgttaccagaaccgaggcgcgccgccaacaaaatgccggtcaccgccgctaataatcccgaaagggtaaagataagaatgcgcacccgacgaacgttgatgccgcacaactgcgccgccgtagcattaccgccaacggcaaaaaccgagcgcccgaaggcggttttgcggctgatgaacacaaacagcgcaaacaacacaatcatgatcagcgcggataccggcacaccgagaaattgtccgcccagccagtccagcacctcgttttcatcaatcggcactggcagtgcgttcgtcataaacagccccattccgcgcagggcgctccacagccccagtgtggcaacgaaacttggtacattaaacacgccgcgcagcaccccggccagcgttcccatcagcgcgcctaacagcaacaccagcaggcacgccaccgccagcggaacttcaaattgcagcaaaaatgccaggcacaccgagacaaaagccaccatcggcccaacgctgacatcaatttcaccggagataataatcagcgtcatcgcccaggcggcaatcccaatggtggcggcatcgcgcagcacgttcatctggttattcaatgagataaagccaggcgcgttcagggagaagaccagataaagaatggcaatcaccaccagcaaaccgatctcattaatatggcgactgacaaattgtttgagcgagacgctcttgccctgcggcaatggtaatgacgaagcagacatcttcaggttcctcggtaaaattcatcagtgcacagacagaatggcggacatcagctcatccacattgaccggagcgtgaaactcctgcgagaacgtgccgtgctgtaataacaggatgcggtcacacaccagcggcaactcctccacttcactggagataaacaccacgctttttccttcggcagccagctcacggacaatacggtaaatctgctgtttggcttcgatatcgacgccgcgcgttggctcgtcgagcaacaaaatctggctggcagcatagacccaacgaccgatcaccactttttgctgattgccaccagaaagcgtgccgatgggtgtttcgctactggcggccttgaccgtcatccgctgcatcacctcttcggtcaggcggcggatggtggaccattgcagcacaccgttggcgctgattttttgccgattggtcagcactgtattttcgtcaacgcccaaccagggaatgatccccgcttctttgcggttttctggcgtatagccaatgccgcgtttcagcatgtcgccgtaatcggggcgcgtgattttctcgccgttgataacaatttcgccctgttcatactcctccagcccaacaatcgccttcagcaattcactgcgccctgcccccagcagaccagcaatgccgagcacttcgccacgacgtagcgtaaaactgatatcctccagcttgggcttatggcgtaacgcacggacttccagcacggcctgatccacaatttcctgaggggctaccggcgcaatatcaacgtgatcgcgcccgagcatcagcgacacaatatgatgcgtggaggtgttttcgagcatcacatcgcccgccacctgaccatcgcgcataacggtggcacaggaggcaatgcggcgaatttcttccatccggtggctgacataaatcaccgccacgcccagtgccgacatctttttcaccgcgctgatcaccagttcaacttccgcactcgcaagcgaactggtaggttcatcaagaatgaccacgcgcggctcgcccttcatcacccgcgcaatttccaccagctgcttttgcgccgggcttagcgttgaaacaagttgttcaggactaacgtcaacgcccagcgcctgtaagcaacgttgggcatcctgcgccatttgcaggtaatcaatcatgccgttgcggcggggccactgaccgaggcagaggttttccgccactgtcagcccttccaccagacttaactcctgataaaccgcgcgcacccccagttcagcggcacggcgagtcagcgtagcttcgtcaccttccagtcgcgtctcgccaatccagatatcaccgctatccgggcgttcgctgccggtaagcattcgaatgagagtcgatttgcccgcgccgtttttacctaacagcgcacgaacttcgcctttattgagcgtgaagttaacgttatccagcgcaacgacgccgggataacgcttatttcctgccaccacttttgctaccgggactgcctctgttgccgtgaacatagggacctctgcgaatcagcgattagggcagaccatcaacgtgcgttgccagccactgtttaccgtcttccgttttggtatagagatcgataggcacctgaatcactttttcaccgtcggcttgtttattgataaccttcaatgtttgcgcgaaaacagcattgcccattttcttaccggaaatatccactaccgctttcagcacctgattgttttccagctcctgagcaatttcggttgtcatatccgaaccgaaaacagcaatttttccggcctgattttgattacgtaccgcttttaccgcgccgagtgtcgcaccgcccgattcccccataatggcgttgagatccggcgtggagataattagtttttcaccaacggaaatcgctttatctaaaacagtcccttcctgattagcgacaatttgcgcgccgggaacgcgggattttaaaacttcttcaaatcctttacgtcgctgcacacaaacttcaaaggcttcgcaattgatgacggcaattttcggctggtcaattttattggcaataaaataatcagcggcagcgttacccagttttttaccaaattccagcggatcgccgaccagatacgccgagacatatttatcgacccccttttgattaatacaggtgttgtagcaaatcaccggaatgcccgcttcactggcgcgacgaacggtacggctactgccattttcagacactgccgataaaataatggcatcgacattacgcgccacgagggtatcaacaaaggtactttctttcgaaatatcaccctgggcgttagtttctattaactgaacttgtactgaggaatcttttgccgcatcctgaacgccctgacgcactccagcgtagtatccctgagtatcaaggtatattgcgccaatggtcatttctttttccgcagccctggcaaatagtgcgctacctaatagcgtagccattaataatagattacgggttgttctcatttttgtaggcatagagcctcctgtagggtttttattaacaacggcttattctaattattttgtgatgagcggcagcgcgtgccgctca

SEQ ID NO: 57 - protein, 318 aa, Artificial Sequence
  Description of Artificial Sequence; note = synthetic construct
MWKRLLIVSAVSAAMSSMALAAPLTVGFSQVGSESGWRAAETNVAKSEAEKRGITLKIADGQQKQENQIKAVRSFVAQGVDAIFIAPVVATGWEPVLKEAKDAEIPVFLLDRSIDVKDKSLYMTTVTADNILEGKLIGDWLVKEVNGKPCNVVELQGTVGASVAIDRKKGFAEAIKNAPNIKIIRSQSGDFTRSKGKEVMESFIKAENNGKNICMVYAHNDDMVIGAIQAIKEAGLKPGKDILTGSIDGVPDIYKAMMDGEANASVELTPNMAGPAFDALEKYKKDGTMPEKLTLTKSTLYLPDTAKEELEKKKNMGY

SEQ ID NO: 58 - DNA, 11100 bp, Artificial Sequence
  Description of Artificial Sequence; note = synthetic construct
ttgcttttctctccgagccgctttccatatctattaacgcataaaaaactctgctggcattcacaaatgcgcaggggtaaaacgtttcctgtagcaccgtgagttatactttgtataacttaaggaggtgcagatgcgtattaccataaaaagatgggggaacagtgcaggtatggtcattcccaatatcgtaatgaaagaacttaacttacagccggggcagagcgtggaggcgcaagtgagcaacaatcaactgattctgacacccatctccaggcgctactcgcttgatgaactgctggcacagtgtgacatgaacgccgcggaacttagcgagcaggatgtctggggtaaatccacccctgcgggtgacgaaatatggtaaagaaaagtgaatttgaacggggagacattgtgctggttggctttgatccagcaagcggccatgaacagcaaggtgctggtcgacctgcgcttgtgctctccgttcaagcctttaatcaactgggaatgacgctggtggcccccattacgcagggcggaaattttgcccgttatgccggatttagcgttcctttacattgcgaagaaggcgatgtgcacggcgtggtgctggtgaatcaggtgcggatgatggatctacacgcccggctggcaaagcgtattggtctggctgcggatgaggtggtggaagaggcgttattacgcttgcaggcggtggtggaataaggtgtgtttatttatcgcgggcataaaaaaacccttactaaccgaagcccggcgttcagggttattacgccagaagaacttatttattctttgcgcgctcgaaggaggcaacgatttcagctttagcggcttctgcgttttcccaaccttcaactttcacccacttgcctttttcgaggtctttgtagtgctcgaagaagtgagcgatttgcgctttcagcagttcaggcagatcgttaacgtctttaatgtgatcgtattctttgctcagcttgctgtgcggaaccgcaaccagtttcgcatcttcaccggcttcgtcggtcattttcagaacgccaaccggacggcaacggatcacagaacccggctgcagcgggtacggagttgggaccagtacgtcaaccgggtcaccgtccagagacagggtgtggttgatgtaaccgtagttgcatggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgccgaatgtcttcgcttgttttcgtcttcattttcctttttcaccagttttaagacggtatacagagcaggaaaatccataaccgtagccgcatttttcatagtgagatgaaagcgattacaaacttgtgattaacgttttatttacttttttgaagtgtgatgtaacgcaatctgttacataacgaattgtctatagttttttcgcgaacatcttttaaccaataataactaccccgacgaggacaaccctatgtggaaacgcttacttatagtctctgcagtctcggcagccatgtcgtctatggcgttggccgctccattaaccgttggattttcgcaggtcggatcggaatcaggctggcgtgccgcagaaaccaatgtggcgaaaagtgaagccgaaaagcgcggaatcacgttgaaaattgccgatggtcagcaaaagcaggaaaaccagattaaagcggtacgttccttcgttgcacaaggggtggatgcgatctttatcgctccggtggtcgcgacaggttgggaaccggtattaaaagaggcgaaagatgccgaaatcccggtattcttgctcgatcgttccattgatgtgaaagacaaatctctctatatgaccaccgtcactgccgacaacatcctcgaaggcaagttgattggtgactggctggtaaaagaagtgaatggcaaaccatgcaacgtggtggagctgcagggcaccgttggggccagcgtcgccattgaccgtaagaaaggctttgccgaagccattaagaatgcgccaaatatcaaaatcatccgctcgcagtcaggtgacttcacccgcagtaaaggcaaagaagtcatggagagctttatcaaagcggaaaacaacggcaaaaacatctgcatggtttacgcccataacgacgacatggtgattggtgcaattcaggcaattaaagaagcgggcctgaaaccgggcaaagatatcctcacgggttccattgacggtgtaccggacatctacaaagcgatgatggatggcgaagcgaacgccagtgttgaactgacgccgaatatggcaggtcccgccttcgacgcgctggagaaatacaaaaaagacggcaccatgcctgaaaagctgacgttaaccaaatccaccctttacctgcctgataccgcaaaagaagaattagagaagaagaaaaatatggggtattgagggttgctatgcctgatgccgattcgtaggccggataaggcgctcggcgcatccggcgatggtgcactgaagcctgatgcgacgcttaccgcgtcttatcatgcctactgggagcacgctttacaccgggggaaaccatgacgaccgaccaacaccaggagatcctccgcaccgaaggattaagtaaatttttccccggcgtcaaagcgttagacaacgttgatttcagcctgcgccgtggcgaaatcatggcgctgctcggtgaaaacggggcgggaaaatcaacgctaatcaaagcattaactggtgtataccacgccgatcgcggcaccatctggctggaaggccaggctatctcaccgaaaaataccgcccacgcgcaacaactcggcattggcaccgtctatcaggaagtcaacctgctacccaatatgtcggtcgctgataatctatttataggccgcgaacccaaacgcttcggccttctacgccgcaaagagatggaaaagcgcgccaccgaactgatggcatcttacggtttctccctcgacgtgcgcgaaccgctcaaccgcttttcagtcgcgatgcagcaaatcgtcgctatttgtcgggctatcgatctctctgccaaagtgctgatcctcgatgaacccaccgccagtctcgacacccaggaagtggagttactgtttgacctgatgcgtcagttgcgcgatcgcggcgtcagcctgatttttgtcactcactttctcgatcaggtctatcaggtcagcgatcggatcaccgtcttacgcaacggcagtttcgtaggctgtcgggaaacgtgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatcgcaccgtttgatctcgaagtacgccccggcgagatcgtcggtctggctggattgctgggatcaggacgtaccgaaaccgccgaagtgatcttcggtatcaaacctgctgacagcggcacggcgttgatcaaaggcaaaccgcaaaacctgcgatcgccacatcaggcttcggtactgggcattggcttctgcccggaagacaggaaaaccgatggcatcatcgctgccgcctcggtgcgggaaaatatcatcctcgctctccaggcccagcgcggctgctacgtcccatttcccgcaaagaacagcaagagattgccgaacgctttatccgccagcttggcattcgcacaccttcaactgaacaaccgattgaatttctctccggcggcaatcagcaaaaagtgttgctttcacgttggctactgacccgaccgcaatttctgatcctcgatgagccaacccgcggcattgatgttggtgcccacgccgagatcatccgcctgattgaaacgctatgcgccgatggtctggcgctgctggtgatctcctccgaactggaagagctggtgggctatgccgatcgggtgattatcatgcgcgatcgcaaacaggtggcggagatcccgctggcagagctttccgttccggcgatcatgaacgccattgcggcgtaaggagaacagtgtgatgcctcaatctcttccggacaccactacgccaaaaaggcgctttcgctggccgacggggatgccgcagctggtagcactattgctggtgctgctggtcgatagcctggtagccccgcatttctggcaggtggtgcttcaggatgggcgtttgttcggtagccccatagacattcttaaccgtgcagctcccgttgcgttactggcgattggcatgacgctggtgatcgccaccggtgggattgatctctccgtaggggcggtgatggctatcgccggagccacaacggctgcgatgacggtcgcgggattcagcctgccgattgttttgttaagcgccctgggcaccggcatcctggcgggattgtggaacggcatactggtagcgatcctcaaaattcagccgtttgtcgccactctgatcctgatggtcgccgggcgcggcgtggcgcaactgatcaccgccgggcagatcgtcacgtttaactcgccggatctctcatggttcggcagtggatcgctgttgttcctgccaacgccggtcattatcgcggtgctgacgcttatcctgttctggctgttgacccgcaaaacggcgctggggatgtttatcgaagccgttggtatcaacattcgggcggcaaaaaatgccggggtaaacacgcgaatcatcgtcatgctcacttatgtgttgagcgggctgtgtgcggcgattgcgggcattatcgtggcggcggatattcgcggtgccgatgccaacaacgctgggttatggctggagctggacgccattctcgcggtggtgattggcggcggatcgctgatgggcgggcgctttaacctgctactttcggtggtgggggcgctgattattcaggggatgaacaccggaattttgctttcgggctttccgccagagatgaaccaggtggtgaaagcggtggtggtgctttgcgtgctgattgttcagtcgcaacgctttatcagtctgattaaaggagtacgtagccgtgataaaacgtaatttgccactgatgatcaccatcggcgtctttgtgttgggttatctttactgcctgacccagtttcccggttttgcttccacaagagtgatctgcaatatcctgaccgataatgcctttcttgggatcattgccgttggcatgacctttgtgatcctctcaggtgggatcgatctctccgtcggttcggtgatcgcctttactggcgtgtttctggcaaaagtgattggcgatttcggcctctcgccgctgctggcgtttccgctagtgctggtgatgggctgtgccttcggcgcatttatggggcttctgatcgacgccctgaagatcccggcatttatcattacgcttgcggggatgttctttttgcgcggcgtcagctatctcgtttcggaagagtcgattccgataaaccatcccatttatgacacgctctcaagccttgcgtggaaaatccctggcggcggtcgcttaagtgcgatgggactgctgatgttggcggtggtggttatcggcatattcctcgcgcatcgtacccgttttggtaatcaggtatacgccattggcggcaacgcaacgtcggcgaatctgatggggatttccactcgcagcaccactattcgcatttatatgctctccaccggactggcaacgctggcggggattgtcttctcgatttatacccaggccggatatgcgctggcgggcgtaggtgtggaactggatgctatcgcctcagtggtaattggcggtacgcttttgagcggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcaataaaaacgcctctccgtgtggagaggcgcaggagattacgcgtccgggaactcacggataaagcgttcgacatcttcaaccatatggtcgttgccgacaaagaatgaacggcgctggtgcagggtttccgggatgatatccagaatacgctctttgccatcgctcgctttaccgcccgcttgttccgccaggaatgccatcgggttgcactcatacagcaaacgcagtttgccgtccgggtggctggcggtgcttgggtagagataaataccgcctttcagcaggttacggtggaaatccgcgaccagtgaaccgatataacgtgaggtataagggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacgccgagcgaaggatcgtaagtaaaggcgtgaacaccgcatccggtggtgtaaaccagcatggtagaggagccgtataccacgtaacctgccgcaacctgtttgttaccaggctggaggaaatcttcttccgttaccggcgtgccaacaggcgtaacgcggcggtagatggagaaaatggtaccgacagagacgttaacatcgatgttggacgagccatccagggggtccatcagcaccacgtattttgcgtgttcacagccttcaaagacgacaatctcatcttcttcttcagaggcaatgcccgcaacgatatcgcgtgctttcagtgcggctttcagtttttcattagcgaacaagtcgagtttctgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatctcaatgttgcgctcaggtgaatcgcgccagcaaattacggattatcctgaaatgcgtttctcacttgcccgacatatgcgtaaaatgagcggcagattaaaaaaggatagtgacgtatgcgcattcatattttaggaatttgtggcacatttatgggcggtctggcgatgctggcgcgccagttaggccatgaagtaacgggttcggacgccaatgtgtatccgccgatgagcaccttacttgagaagcaaggcattgagctgattcaggggtacgatgccagccagctcgagccgcagccggatctggtgattattggcaacgccatgacccgtggaaatccgtgtgtggaagcggtactggaaaaaaatatcccttatatgtcaggtccacagtggctgcacgattttgtgctgcgcgaccgctgggtgctggccgttgccggtacacacggcaaaaccaccaccgcgggaatggcgacctggattctggaacagtgtggttacaaaccgggctttgtaatcggcggtgtgccggggaactttgaggtttcggctcatctgggcgaaagcgacttctttgttatcgaagcggatgagtatgactgcgccttcttcgacaaacgctctaaatttgttcattactgcccgcgtacgctgatcctcaacaaccttgagttcgatcacgccgatatctttgacgacctgaaagcgatccagaaacagttccaccatctggtgcgtatcgttccggggcagggccgtattatctggccggaaaatgacatcaacctgaaacagaccatggcgatgggctgctggagcgagcaggagctggtgggtgagcagggtcactggcaggcgaaaaagctgaccaccgatgcttccgaatgggaagttttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaatgctcgtcgccgtctggagttgcgtggtgaagcgaatggcgtcacggtatatgacgattttgcccatcacccgacggcgattctggcaacgctggcggcgctgcgtggcaaagttggtggtacggcgcgcattattgctgtgctggagccgcgctcgaataccatgaaaatggggatctgcaaagacgatctggcaccttcattaggtcgtgccgatgaagtcttcctgctgcaaccggcgcatattccgtggcaggtggcagaagtggcagaagcctgcgttcagcctgcacactggagtggcgatgtggatacgctggcagatatggtggtgaaaaccgctcagcctggcgaccatattctggtgatgagcaacggcggttttggtgggatccatcagaaactgctggatgggctggcgaagaaggcggaagccgcgcagtaattcggccttagccagatatagtatgcgtaggccggataaggcgttcacgccgcatccggcatttgagcatagtgcctgatgcgacgcttgatgcgtcttatcaggcctacaggtgcaccgtatccggcaaaccatactcacatcaacaacgaaaattacccttcgttctccgctaactcgcgcagatactggaaaatctggcgtgcggatttcggcggcttattcccttctttctctttcttcgcgttgcggatcagagtacgcagttgctgacgatcggcatcgggccacagatttaatacctcagcgatggcgtcatcaccttgatcgatcagacgatcgcgcaggttttccagtttatggaacagcaccacctgctggttgtgacggtttttcagcttatccagcgcctgacgaataggctctacgtcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttccgcgccaaggcgttttagctcctcggcatcacgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttccactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcactgtttatcaccagaaccgcaaaggtagcgcatcatccaccgatttaagcccgcaggccattgcccgtactgtacaggcggcgctggatattgcccgttatacctcgccagatccctgtgccggcgtggcagacaaagagctgctggcctttgacgcaccagatctcgacttgttccaccctgcggaagtttccccggatgaagccattgaactggcggcccgcgcagaacaggcggcattgcaggcggacaaacgcatcaccaataccgaaggtggcagctttaacagccactacggtgtcaaagtttttggcaacagccacggcatgttgcagggttactgctcaacgcgtcattcgctctccagctgtgtaattgccgaagaaaatggcgatatggagcgtgattacgcctacaccattggtcgtgcgatgagcgatctgcaaacgccagagtgggttggggccgactgtgctcgccgtactttatcgcgtctgtcaccgcgtaaactctccaccatgaaagcgccagtcatttttgccaatgaagtggcaaccgggctttttgggcatctggtgggggcgatagcgggtggatcggtttatcgtaaatctaccttcctgctggattcgctgggtaaacaaattctgccggactggctgaccattgaagagcatccgcatctgctgaaagggctggcgtcgacgccattcgacagcgaaggtgtgcgcaccgagcgtcgcgatattattaaagatggcatcctgactcagtggctgctgaccagctactcggcgcggaaactggggctgaaaagcaccggacatgcgggcggtattcacaactggcggattgccggacaaggtctaagcttcgagcagatgctcaaagagatgggcaccgggctggtggtgacggaattgatgggccagggcgtgagtgccattaccggtgattattcccgtggtgcagcgggcttctgggtagagaatggcgaaattcagtatccggtgagcgaaatcaccatcgcaggtaatttaaaagatatgtggcgcaatattgtcaccgtcggtaacgatattgaaacacgcagtaatatacagtgtggttctgtgctgttgccggagatgaaaatcgccggacagtaaaaaaactggcgcgacctgccgcgctataaactaaaaaattacacaaaatcattcgcactgcatcgagacggaaagtgaatgagggccggggagcgtactcgcagt

SEQ ID NO: 59 - protein, 1676 aa, Artificial Sequence
  Description of Artificial Sequence; note = synthetic construct
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 60 - DNA, 604 bp, Artificial Sequence
  Description of Artificial Sequence; note = synthetic construct
gaattccgcaaggagcacacccggctgtccacctgctgcagagatggtgcacgcaacctccccgctgctgctgctgctgctgctcagcctggctctggtggctcccggcctctctgccagaaagtgctcgctgactgggaaatggaccaacgatctgggctccaacatgaccatcggggctgtgaacagcagaggtgaattcacaggcacctacatcacagccgtaacagccacatcaaatgagatcaaagagtcaccactgcatgggacacaaaacaccatcaacaagaggacccagcccacctttggcttcaccgtcaattggaagttttcagagtccaccactgtcttcacgggccagtgcttcatagacaggaatgggaaggaggtcctgaagaccatgtggctgctgcggtcaagtgttaatgacattggtgatgactggaaagctaccagggtcggcatcaacatcttcactcgcctgcgcacacagaaggagtgaggatggccccgcaaagccagcaacaatgccggagtgctgacactgcttgtgatattcctcccaataaagctttgcctcagacaaaaaaaaaaaaaggaattc

SEQ ID NO: 61 - protein, 183 aa, Artificial Sequence
  Description of Artificial Sequence; note = synthetic construct
MRKIVVAAIAVSLTTVSITASASADPSKDSKAQVSAAEAGITGTWYNQLGSTFIVTAGADGALTGTYESAVGNAESRYVLTGRYDSAPATDGSGTALGWTVAWKNNYRNAHSATTWSGQYVGGAEARINTQWLLTSGTTEANAWKSTLVGHDTFTKVKPSAASIDAAKKAGVNNGNPLDAVQQ

SEQ ID NO: 62 - DNA, 638 bp, Artificial Sequence
  Description of Artificial Sequence; note = synthetic construct
ccctccgtccccgccgggcaacaactagggagtatttttcgtgtctcacatgcgcaagatcgtcgttgcagccatcgccgtttccctgaccacggtctcgattacggccagcgcttcggcagacccctccaaggactcgaaggcccaggtctcggccgccgaggccggcatcaccggcacctggtacaaccagctcggctcgaccttcatcgtgaccgcgggcgccgacggcgccctgaccggaacctacgagtcggccgtcggcaacgccgagagccgctacgtcctgaccggtcgttacgacagcgccccggccaccgacggcagcggcaccgccctcggttggacggtggcctggaagaataactaccgcaacgcccactccgcgaccacgtggagcggccagtacgtcggcggcgccgaggcgaggatcaacacccagtggctgctgacctccggcaccaccgaggccaacgcctggaagtccacgctggtcggccacgacaccttcaccaaggtgaagccgtccgccgcctccatcgacgcggcgaagaaggccggcgtcaacaacggcaacccgctcgacgccgttcagcagtagtcgcgtcccggcaccggcgggtgccgggacctcggcc

SEQ ID NO: 63 - protein, 221 aa, Artificial Sequence
  Description of Artificial Sequence; note = synthetic construct
MSGKPVLHYANTRGRMESVRWLLAAAGVEFEEKFLEKKEDLQKLKSDGSLLFQQVPMVEIDGMKMVQTRAILNYIAGKYNLYGKDLKERALIDMYVEGLADLYELIMMNVVQPADKKEEHLANALDKAANRYFPVFEKVLKDHGHDFLVGNKLSRADVHLLETILAVEESKPDALAKFPLLQSFKARTSNIPNIKKFLQPGSQRKPRLEEKDIPRLMAIFH

SEQ ID NO: 64 - DNA, 933 bp, Artificial Sequence
  Description of Artificial Sequence; note = synthetic construct
gaattcgggagcaggaaatcagatacgtgggaacatgtctgggaagccagttctgcactatgccaacacacgaggccgaatggaatcagtacgctggctgctagcggctgctggagttgagtttgaagaaaaatttctggaaaaaaaggaagatctccaaaagttaaagtcagatggatccctgctgttccagcaagtgcccatggtggagattgatgggatgaagatggtgcagaccagagccatcctcaactacatagcagggaaatacaatctctacgggaaggatctgaaggagagagccctaattgacatgtatgtggaaggactggcagatctgtacgagttaatcatgatgaacgtcgtccaaccagcagataaaaaggaggaacatcttgctaatgctttggataaggccgcaaacagatatttcccagtctttgagaaggttttgaaggaccacggacatgactttcttgttggcaacaagctgagcagagcagacgtgcatttactggaaaccattttagcggtggaagagtcgaagcctgatgcacttgcaaaatttcccctcttgcagagttttaaagcaagaacaagcaatatccccaacatcaagaaattcctgcagcctggcagccaaaggaaaccacgcctagaggaaaaagatataccaagactgatggcaattttccactgaacatcaacctaaacccactgaaactccatttcattctgtttgctgataagcggagtgaaattaatgaaattagtgaggtttgtgatgtgtctttcttcagcctacagcaaatacttccaaagcaaatcactcaattaggcggtacactggatgaaactgccttaaatacttaagagttttcctcaaataaagtcccactattgacgttaaaaaaaaaaaaaaaacccgaattc

SEQ ID NO: 65 - protein, 372 aa, Artificial Sequence
  Description of Artificial Sequence; note = synthetic construct
MWSWFGNSQPKTQDHTATATTALRSSSGTTPKTATKRREAQDWLSWWFQPSESKNHLHTTTIMAGTDSSIISAGWEPTEENEDERDKHPSYSGSGIDDDEDFISSTIPTTPRLFSHPKQNQDWTPWSPGESNPEVLLQTTTRMTDVDRSGTSANGENWTREPHSPLIHHEHHDEEEAQHATSTTEAIPSSTIEETATQKEQWVENGWHGKYPQSPKEDSHSTAGTAATAQDSHPDQKTTTQSQEDSSWTYFFDPISHPMGPGHQTERWMDMDSSHSPTSQPSADPNTHLVEDLDRIGPLSMTTQQVILRASPHHLEAWKKIKTIQRLLLQLAIELMAEVEEKVDIFPKTQLLQWKLLLLTRQPQMNTGPSSR

SEQ ID NO: 66 - DNA, 1261 bp, Artificial Sequence
  Description of Artificial Sequence; note = synthetic construct
attacttcagctgtgcactcaaacagccatgcagcagttcaggagcaaaataattggatgtggtcctggtttggtaactcacagcctaagactcaggatcacacggcaacagcaacaacagctttgaggagctctagtggtacaactcccaaaacagcaaccaagaggcgagaagcccaggattggctttcatggtggtttcaaccatcagagtccaagaatcatcttcacacaacaacaataatggctggtacggattcaagtatcatctcagcaggctgggaaccaactgaagaaaatgaagatgaaagagacaaacaccccagttattctggatcaggcattgatgatgatgaagattttatctccagcaccattccaaccacaccacggctttttagccacccaaaacagaaccaggattggaccccgtggagcccaggcgaatcgaatccagaagtattacttcagactactacaaggatgactgatgtggacagaagtggcaccagtgctaatggagaaaactggacccgcgaaccacactctcctctcattcaccatgagcaccatgatgaagaggaggcccagcatgctacaagcacaaccgaggcaatccctagtagtacaatagaagaaacagctacccagaaagagcagtgggttgagaatggatggcatgggaaatatccgcagtcaccaaaagaagactctcattcaacagcagggacagctgccacagcccaagacagccatccagatcaaaaaacgacaacgcagagtcaagaggacagctcctggacttatttctttgacccaatctcacatccaatgggaccaggtcatcaaacggaaagatggatggatatggactccagccatagtcccacaagtcagccttctgcagatccgaacacacatttggtggaagacttggacaggataggacctctttcaatgacgactcagcaaagtcatactcagagcttctccacatcacctggaggcttggaagaagataaaaaccatccaacggcttctactccaactagcaatagaactgatggcagaggtggaagagaaggtggacatcttcccgaagactcagctccttcagtggaagcttctccttctcactcgccagccacaaatgaatacaggaccctcatcccggtgacccccgctaagacggggttccctggagttactgaagttaatattgctggagattccaattctaacgttattcatttcctttcag

SEQ ID NO: 67 - protein, 1210 aa, Artificial Sequence
  Description of Artificial Sequence; note = synthetic construct
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYALAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVGLNITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNILEGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGPKIPSIATGIVGGLLFIVVVALGIGLFMRRRHIVRKRTLRRLLQERELVEPLTPSGEAPNQAHLRILKETEFKKIKVLGSGAFGTVYKGLWIPEGEKVKIPVAIKELREATSPKANKEILDEAYVMASVDNPHVCRLLGICLTSTVQLITQLMPYGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASDISSILEKGERLPQPPICTIDVYMIMVKCWMIDADSRPKFRELILEFSKMARDPQRYLVIQGDERMHLPSPTDSNFYRALMDEEDMEDVVDADEYLIPQQGFFNSPSTSRTPLLSSLSATSNNSTVACINRNGSCRVKEDAFLQRYSSDPTGAVTEDNIDDAFLPVPEYVNQSVPKRPAGSVQNPVYHNQPLHPAPGRDLHYQNPHSNAVGNPEYLNTAQPTCLSSGFNSPALWIQKGSHQMSLDNPDYQQDFFPKETKPNGIFKGPTAENAEYLRVAPPSSEFIGA

SEQ ID NO: 68 - DNA, 4188 bp, Artificial Sequence
  Description of Artificial Sequence; note = synthetic construct
ggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggccaaagataccatctattgccactgggattgtgggtggcctcctcttcatagtggtggtggcccttgggattggcctattcatgcgaagacgtcacattgttcgaaagcgtacactacgccgcctgcttcaagagagagagctcgtggaacctctcacacccagcggagaagctccaaaccaagcccacttgaggatattaaaggaaacagaattcaaaaagatcaaagttctgggttcgggagcatttggcacagtgtataagggtctctggatcccagaaggtgagaaagtaaaaatcccggtggccatcaaggagttaagagaagccacatctccaaaagccaacaaagaaatccttgacgaagcctatgtgatggctagtgtggacaaccctcatgtatgccgcctcctgggcatctgtctgacctccactgtccagctcattacacagctcatgccctacggttgcctcctggactacgtccgagaacacaaggacaacattggctcccagtacctcctcaactggtgtgtgcagattgcaaagggcatgaactacctggaagatcggcgtttggtgcaccgtgacttggcagccaggaatgtactggtgaagacaccacagcatgtcaagatcacagattttgggctggccaaactgcttggtgctgaagagaaagaatatcatgccgaggggggcaaagtgcctatcaagtggatggctttggaatcaattttacaccgaatttatacacaccaaagtgatgtctggagctatggtgtcactgtgtgggaactgatgacctttgggtccaagccttatgatggaatcccagcaagtgacatctcatccatcctagagaaaggagagcgccttccacagccacctatctgcaccatcgatgtctacatgatcatggtcaagtgctggatgatagatgctgatagccgcccaaagttccgagagttgattcttgaattctccaaaatggcccgagacccacagcgctaccttgttatccagggggatgaaagaatgcatttgccaagccctacagactccaacttttaccgagccctgatggatgaagaggacatggaggatgtagttgatgctgatgagtatcttatcccacagcaaggcttcttcaacagcccgtccacgtcgaggactcccctcttgagttctctgagtgcaactagcaacaattccactgtggcttgcattaatagaaatgggagctgccgtgtcaaagaagacgccttcttgcagcggtacagctccgaccccacaggtgctgtaacagaggacaacatagatgacgcattcctccctgtacctgaatatgtaaaccaatctgttcccaagaggccagcaggctctgtgcagaaccctgtctatcacaatcagcccctgcatccagctcctggaagagacctgcattatcaaaatccccacagcaatgcagtgggcaaccctgagtatctcaacactgcccagcctacctgtctcagtagtgggtttaacagccctgcactctggatccagaaaggcagtcaccaaatgagcctagacaaccctgactaccagcaggacttcttccccaaggaaaccaagccaaatggcatatttaagggccccacagctgaaaatgcagagtacctacgggtggcacctccaagcagtgagtttattggagcatgacaagaaggggcatcataccagctataaaatgtctggactttctagaatcccaggaccaactatggcagcacctccacttctggtagccatgcccacgctgtgtcaaatgtcactcagactggctttaaagcataactctgatgggctttgtcactgagccaagaagtgggcctctctcctgatgcactttgggaagttgaaggtacatcaattgatcttcgaactgtgaagattccacaaaaaaggtatccatcgagaacattgtccattggaacagaagtttgcctcatggtgaggtacataggggaaaaaaacagacatatggagcttatatttagggaactttgggattcttgtctttattgatttgattgatgcactcttgtagtctggtacacagagttgcctggagccaactgaccagacagttggttccaccagctctgcatcaagagacttccgtggcaagacaactaaatgtataagaagtccatgg

SEQ ID NO: 69 - protein, 1089 aa, Artificial Sequence
  Description of Artificial Sequence; note = synthetic construct
MGTSHQVFLVLSCLLTGPGLISCQLLLPSILPNENEKIVQLNSSFSLRCVGESEVSWQHPMSEEEDPNVEIRSEENNSGLFVTVLEVVNASAAHTGWYTCYYNHTQTDESEIEGRHIYIYVPDPDMAFVPLGMTDSLVIVEEDDSAIIPCRTTDPETQVTLHNNGRLVPASYDSRQGFNGTFSVGPYICEATVKGRTFKTSEFNVYALKATSELNLEMDARQTVYKAGETIVVTCAVFNNEVVDLQWTYPGEVRNKGITMLEEIKLPSIKLVYTLTVPKATVKDSGEYECAARQATKEVKEMKRVTISVHEKGFVEIEPTFGQLEAVNLHEVREFVVEVQAYPTPRISWLKDNLTLIENLTEITTDVQKSQETRYQSKLKLIRAKEEDSGHYTIIVQNEDDVKSYTFELSTLVPASILDLVDDHHGSGGGQTVRCTAEGTPLPEIDWMICKHIKKCNNDTSWTVLASNVSNIITELPRRGRSTVEGRVSFAKVEETIAVRCLAKNNLSVVARELKLVAPTLRSELTVAAAVLVLLVIVIVSLIVLVVIWKQKPRYEIRWRVIESISPDGHEYIYVDPMQLPYDSRWEFPRDGLVLGRILGSGAFGKVVEGTAYGLSRSQPVMKVAVKMLKPTARSSEKQALMSELKIMTHLGPHLNIVNLLGACTKSGPIYIITEYCFYGDLVNYLHKNRDSFMSQHPEKPKKDLDIFGLNPADESTRSYVILSFENNGDYMDMKQADTTQYVPMLERKEVSKYSDIQRSLYDRPASYKKKSMLDSEVKNLLSDDDSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVQCWNSEPEKRPSFYHLSEIVENLLPGQYKKSYEKIHLDFLKSDHPAVARMRVDSDNAYIGVTYKNEEDKLKDWESGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 70 - DNA, 5110 bp, Artificial Sequence
  Description of Artificial Sequence; note = synthetic construct
ctcagggttttccgcaatcaggccagcccttctactgctgtccgttttttgggtccagcaaaataacagaagacagcgaggtggacttcctggagggggtgatagctcacatcagaagccatctgtagcccggacaccatggggcttccaggagtgataccagctttagtcctcagaggccagttgttgctgtccgtgttatggctcctgggaccgcagacctcccggggcctagtcatcacgccccctgggccagagtttgttctcaacatctccagcacctttgttctgacctgctcgggctcagctccggtgatgtgggaacagatgtcccaggtgccctggcaagaagcggccatgaatcaggacggcaccttctccagtgtgctgacactgaccaatgtcactgggggagacactggggaatacttttgtgtctacaacaactcactagggccggagctcagtgagaggaagcgtatctatatctttgtgccagatcccaccatgggcttcctccctatggactccgaggacctgttcatttttgtcacggatgtcactgagacgacaattccgtgccgagtgacagacccccagctggaggtgacgctacatgagaagaaagtggatatccccctacacgtaccctacgaccaccagcgaggtttcactggtacttttgaggacaagacttacatttgcaaaaccaccattggggacagggaagtggactccgatacttactacgtctacagcctccaggtgtcatccatcaacgtctctgtgaatgccgtgcagactgtggtccgccagggcgagagcatcaccatccggtgcattgtgatgggcaatgatgtggtgaacttccaatggacgtacccccgcatgaagagtgggcggctggtggagccagtgacagactacctctttggagtgccctcccgcattggctccatcctgcatatccccacggctgagctgagtgattcgggcacctatacttgcaacgtgtcagtgagtgtgaacgaccatggcgatgagaaagccatcaacatctctgtgatcgagaatggctacgtgcggctgctggagacactgggagatgtagaaattgctgagctgcaccggagtcggacgctgcgggtggtgttcgaggcttatccgatgccttctgtcctgtggctcaaggacaaccgtaccttgggtgactccggcgctggcgagttagttttgtctactcgcaacatgtctgagacccggtacgtgtcagaactgatcctggtacgtgtgaaggtgtcagaagcgggctactatactatgcgagccttccacgaggacgatgaggtccagctctccttcaagctgcaggtcaatgtccccgtccgtgtgctggagctgagtgagagtcaccctgccaatggggagcagacaatccgctgtcgtggccggggcatgcctcagccaaatgtcacctggtctacctgcagagacctcaaaaggtgtccacgaaaactgtcacccacacccttggggaatagttccaaggaggagagccagctagaaacgaatgtgactttctgggaggaagatcaggaatacgaggtggtgagcacactgcgcctgcgccacgtggatcagccactgtccgtacgctgcatgctgcagaactccatgggtggagattcgcaggaggtcaccgtggtcccacattccttgcccttcaaagtggtggtgatctcagccatcctggccttagtggtccttaccgtcatctctctcatcatcctcatcatgctgtggcagaagaagccacgctatgagatccgatggaaggtcattgagtctgtgagctctgacggtcatgagtacatctacgtggaccctgtgcagttgccttacgactccacctgggagctgccacgggaccagcttgttctgggacgcactcttggctctggggctttcggacaggtggtggaggccacagctcacggtctgagccattcgcaggccaccatgaaagtggctgtcaagatgctgaaatcgacagccagaagtagcgagaagcaagccttaatgtccgagctgaagattatgagtcatcttggaccccacctgaacgtggtcaacctgctgggggcctgcaccaaaggagggcccatctacatcatcacggaatactgccgatacggtgatctggtggactacctgcaccggaacaaacacaccttcttgcagcgacactccaacaagcattgtccgcccagtgctgagctctacagcaacgccctgccagtggggttctccctacccagccacttgaacctgactggggagagtgacggtggctacatggatatgagcaaggatgaatctatagattacgtgcccatgttggacatgaaaggagacatcaaatacgcagacattgagtcccccagctacatggccccttatgataactatgtcccatctgcccctgaaaggacctatcgcgccaccttaatcaacgactcaccagtgctcagctacacagacctcgtgggcttcagctaccaagtggccaacggcatggacttcttagcctctaagaactgtgttcaccgagacttggcggccaggaatgtgctcatctgcgagggcaagctggtcaagatctgtgacttcggcctggctcgagacatcatgagggactcaaactacatctccaaaggcagcacctacctgcctctgaagtggatggccccagagagcatcttcaacagcctctacaccactttgagtgatgtctggtcttttgggatcctactctgggagatcttcacactgggtggcaccccttacccagagctgcccatgaacgaccagttctacaatgccatcaagaggggctaccgcatggcccagcctgctcatgcctccgacgagatctatgagatcatgcagaaatgctgggaagaaaagtttgagactcgaccccccttctcccagctggtgctgctcctggagaggcttctgggtgaaggctataaaaagaagtaccagcaggtagatgaggagttcctgaggagtgaccatcctgccatcctgaggtcccaagcccgctttccggggatccacagcctccgatcccctctggacaccagctctgttctctacactgccgtgcagcccaatgagagtgacaatgactacatcatccccttacctgaccccaagcctgacgttgctgatgaaggtctcccagaggggtcccccagccttgccagttccaccttgaatgaagtcaacacttcctccaccatctcctgcgacagtcccctggagctccaagaagagccacagcaagcagagcctgaggcacaactggagcagccacaggattcaggctgcccaggacctctggctgaagcagaggacagcttcctgtaggaactgacatcactccattttgcccgaatctcccttctgcctcccagaacccaaccctcttggcctggcctggcctggcctggcctcccagcagctacactgccacaagctgtcccctcgaggaaagcccttggtttgcagcactcaaggtccagggacccagcttagcttaggaggcaagagaactctgcctcgggaaggtcatgggactctgaaccagggttcctccaggggactcagtttccccaaatgtaagaggaagagttgtacttggctacaggacaggtctggagcccggattcctgcagaaatccacgactgtacggtggtgtgttcatatcctcctgtgtagcagctgcccctcagctggattgctctactttgatcttcctaagaatcaggcaaggacctggtgtctggctcctggccaaactgtaaccagccttggacaaggtcttttcattcagagcccacctcccctggtcttagctttcccaggcccgagctggtctggggccagccatgcttaatgaatgctgttagtggtgaaggtaggccgagtacagaatgctctggcctgcagccctgcctgggcactcagggcacacctggccacaggaagcacccactcctttcagccccaccagtcctagaatagtccccaggtcactctcagctgacccacccaccagagtctgcagggccattgtccacgcctgtgataggtaagcatctgcctgaagtgtgtacctaccactaggagccctggctctgcgctggacctgctatgagaccttgggggctttccttgttctctctggggaccagttttctttcccctttgaaaagcaagttggacacatagactctgagtaccctgtcaatagtacaattcttgtatgttctgggagtttgctcttgtcccgaggaagcagggtcaagtccttaaactgatctttctaggggtcagctgagctcttggaagatccctgatacacttcacactctgggggttcaggaaccgagcctcttcttcaagtctccaagtgcaactgcccagaccttgacttggagtgacagtgagtgtcctaggaaacccccttacagctgtcctgaggacacagaagagaccacgagacccttttttcatatcatgaagccagcaagagtggcagagaaggcaagccaggttacctcgggccactgtcaccagcagcgtgtggacagacatgatggacagtgaggacagacgtcccatgcaggacaagagacttgagatgggcaatgagaggaagatgctgacgggattaccacctcaactgccagctgcccccgtccccagggagcaccccacagaaacagttctaaccctgaaccaatgaacattgcaagtgcctggggactagggagtggggggaagtcagcctttctggggaccctccctgctagctggttggctagctggcatctccccgcttggagcagcagaggctggggagtactgctcacaatggtaccaaagatagaatcacctaggtttacaagtacttgtaggactcgagataacccacatttagacaccggaagtgctattttatatgctgttaagttttcctatctgtactttttttttaaatgggaaagattttaatattaaacttggtgcttctcactg

SEQ ID NO: 71 - protein, 742 aa, Artificial Sequence [sequence omitted]

SEQ ID NO: 72 - DNA, 989 bp, Artificial Sequence
  Description of Artificial Sequence; note = synthetic construct
ctattttctgggaaactgtagttgaagagattcaggttatagcataagaagagtactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttggctcaattaaatatgaatttcctattgtgtgcaatcagcccttt

SEQ ID NO: 73 - protein, 378 aa, Artificial Sequence
  Description of Artificial Sequence; note = synthetic construct
MMLVRSVFRSQLRPSVSGGLQSASCYSSLSAASAEAERTIREGPRNDWSRDEIKSVYDSPLLDLLFHGAQVHRHVHNFREVQQCTLLSIKTGGCSEDCSYCPQSSRYSTGVKAQRLMSKDAVIDAAKKAKEAGSTRFCMGAAWRDTIGRKTNFSQILEYIKEIRGMGMEVCCTLGMIEKQQALELKKAGLTAYNHNLDTSREYYPNVITTRSYDDRLETLSHVRDAGINVCSGGIIGLGEAEEDRIGLLHTLATLPSHPESVPINALLAVKGTPLEDQKPVEIWEMIRMIGTARIVMPKAMVRLSAGRVRFSMSEQALCFLAGANSIFTGEKLLTTPNNDFDADQLMFKTLGLIPKPPSFSEDDSESENCEKVASASH

SEQ ID NO: 74 - DNA, 1413 bp, Artificial Sequence
  Description of Artificial Sequence; note = synthetic construct
gggttaggtgaatcactcactgaagagtgaaaagctctagcacaaaccaaacaccaaatctcatttcttcttcttcttctttttccacattttctgattagcagatcaaatgatgcttgttcgatctgtatttcgatctcagttgcgaccctctgtctcgggtggtctgcaatctgcttcttgctattcttcattatctgctgcttcagctgaagctgagaggactatcagagaaggtcccagaaacgattggagtagagatgaaatcaagtctgtttatgattctcctcttcttgacctcctcttccatggagctcaggttcatagacatgttcataacttcagggaggtacaacaatgtaccctcctctccataaagactggtggctgtagtgaagactgttcatattgtcctcagtcttcgagatatagcactggagttaaggcacaaagactcatgtctaaggacgctgtcattgatgctgctaagaaggcaaaagaagctgggagcacacgtttttgcatgggtgctgcttggcgagatacaattggacggaaaaccaacttcagccagattcttgaatacatcaaagaaataagaggcatggggatggaagtttgctgcaccttaggcatgattgagaaacaacaagcactagagctaaagaaggctggcctcactgcttataaccacaatcttgatacttcaagagagtactacccaaacgtcatcactactagaagttatgacgatcgccttgaaactcttagccatgttcgtgatgctggaatcaacgtttgttcaggaggaatcatagggcttggtgaggcagaggaagacagaataggtttattacacacgctggcaacacttccttctcaccctgagagtgttcccattaatgctctacttgcagtgaaaggcactcctcttgaagaccagaagccagttgagatatgggagatgatcaggatgattggaaccgcacgtattgtaatgccaaaagcgatggtgagactgtctgctggtagagtccggttctcaatgtccgaacaagctctctgtttccttgctggtgcaaactctatcttcaccggagagaagcttttaaccacaccaaacaatgattttgacgctgaccagctcatgttcaagacattaggcctcattcctaaaccgccaagtttctctgaagatgattctgaatcagaaaactgcgagaaagttgcttccgcttctcactaatatcattatccactttttttttttgtttggagtcgggacactatagagcagtcccttttactatgtagcatggtttgacgattttgtgatatcatttttcgttaatcgttattcgaagatgtctagatttctcatctgaaagtaaacttattattctagagtgtcat

SEQ ID NO: 75 - protein, 474 aa, Artificial Sequence
  Description of Artificial Sequence; note = synthetic construct
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 76 - DNA, 1918 bp, Artificial Sequence
  Description of Artificial Sequence; note = synthetic construct
gaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattcaaaaaaaaaaaaaaaaaaa

SEQ ID NO: 77 - protein, 257 aa, Artificial Sequence; identical to SEQ ID NO: 13
  Description of Artificial Sequence; note = synthetic construct

SEQ ID NO: 78 - DNA, 13991 bp, Artificial Sequence
  Description of Artificial Sequence; note = synthetic construct
gatctcatcgaagcgattgagcaccagtaccagagtaataccggactgatgtaacgaggcgagtcgctcagccagctgctgacgtgaggcaacatccaggccatcgaacggctcatcaagaatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaatgatctcagccgtagtgcgtccggtgtcatcttcgccagggccgagcatatcggtgttattccgctgccattcgtcgctgacgagtttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccactttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacccggtaattggttgtcagcgttttgcgcgaccgcctcgtcctgagtaatacctacccacggcgcttttagcaatatcaacacttctttgccttcatccagccccagacgcgcgccgctttgtgcggtaattgcgactttcaggcgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcgccgccgccacctttaccgcctgttgcgcgctcgaccagaatatgctcacttaactgattcatctcgttaatggcatcccaggcgcttttatagctaataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgcttttcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacacccgttgggcggctgatattcatatcaccccggatggtcgccatttatacgcctgcgaccgtaccgccagcctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatattctcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatgcttgcgcatcttatccgacctacaaatcgcatcgaaccgtaggccggataaggcgtttacgccgcatccggcaaatagttaattgctcttacttcttcgcctctgcaaccactttactacccacgccgcggttattgtattcccacatgcggttgtagttagtgtcattcagattgcgctgtatttcgtcgttatcatctacgctgccggtattacccgcaaacggacgattagagatcaccgcatcggcccacggtttagccgtgttaaaaccttcgttgatggcgctatcacggatcaccacctgaccgttggtattggcatcaacatccagcgagcggcccagttgcgccacaccatcaccgaaagcattgaaacggctgtttacggcgaggaaaccgtagtaaatgttggacagcgtagccggtgcaaacacatacgcttcttgctgagtacgtgagttcaccacgcggaattcggtgttatcgaacaccactgcgccgcgaccagaaacgatatccacatccccttcaatgtagctgttggtcaccagcgtacgcggctgacgattcgtttccagacggttctgcacaccgctgttggtgacaaagaaggtgttctgacgaccgagaatgttaacgttgttaatctgtacctggtcaccatcagtacgcagtgccaccgccggatggttacctgcatctacgctatcgcccagcgtgttttcgatggtcagattttgcagttgcaggccattgttttgtgaccagaagaccgcagagcagagaacaccgatactgtcgctgcgtttgctctggcagctatcgtacatataccacgctggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatataccgttccctgatactcaccaggcatcacggcaatatactggcgcttgttggtacgcttgataattgccgcatctaccgccgcctgaatcgtggtatgcgttacaccttgagtgcccgccgggccgacaacaaagtcaggttgcgcaggcagggtaatcggggaaggattccacgctgcagcacctggtgtcagggatgcaaaatagtgttgagcatcgaaattctgcgcttcttttgccgacagaatcgggcgagaagaggtaccaggcgcggtttgatc

SEQ ID NO: 79 - protein, 348 aa, Artificial Sequence; identical to SEQ ID NO: 21
  Description of Artificial Sequence; note = synthetic construct

SEQ ID NO: 80 - DNA, 16255 bp, Artificial Sequence
  Description of Artificial Sequence; note = synthetic construct
gaattctgccagatgtgtcacgtcacagtggggcgggatttccccgcgcgcttgtcgttgacataaaaactgctgcaaagtgcgctcttgcatcgcatggcgtgatttcaacgtattggcgatatctcctgaatctggggagagggtggtgcagttgttgatcatgaagcagcctgccggggtgtctttgctggtaaagcagttggcgatggcagcaaaatagtcagccagcgcagactccacgcttttctcttcacaaaacagctgtgcttcatgcttagcggcaaaacgatcgatatagcggtcgagaacggcacgaaataacccctctttgttggtaaattccgcgtatagcgtgggcgctttggctccggtcgcttcgacgaggtccgcaagagaagtcgcttcataaccgtgttgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagatcccataaaaataattgctttctatttaactgaaatttaaagatttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaccctcatcgctgcggcgattttaagctccatgtcatttgccagctttgcggctgtcgaagttcagtcaacgccagaaggccaacaaaaagtcggtacaatcagtgctaacgcggggacaaatctgggatcgctggaagagcagctggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccatgaagcaaataaacgccgccataggccgccagacgaatcgcatgatggcccattgggttatccagtccagccggcactaccgcaggcaactcaattccctgtgctttataacgggcgcggatgtttgccgttggcgtccaggttgggtttgcacgtttgtctgaaacggtggtcaccattgtcggtgtcagcgtgtcaccacctaactgaccaatacctattggatacacggttaccgaatttttacccggcgggtagtaatagagacgcagctccgcaatgttgatcacaatgccttcgcgcggcgcatctggaagtagggtttgcaacgggatcgttaacacgctgcccgcgcgcggtacgtaaggatcaacgccggggttagcctgtaacagagcgagaaagccgacgttgtattttttggcgatggcttccagagaaccaccgtcattttccaccacatgaaatttgttttcgccaaccagacgactgcccgctggcggcagcggccaggtgttggcttttgccggtagcgccagcgccacggcagcggcgaacgtaaaaaacgttagccagcgagaaaaacgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccccgatttaccattaagcgatcgcgttctcttccagttcacgcataaactggcgtacccattcgatacgcgttttccgctcactcaaatcctgaataaatttcaggcgcgtcggaccatcaaggcggtaatgctgcggctgtttttgcagcaaaccaatcaaccaggccggattaacgtgattcttctcggcaaattcgatcaccccgcctttctcattaccttccagcttcctgatccccagtttctgcgcttgctggcgcagacgggcaatatccagcagggtacgcgccggatctggcagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcagctcgacttctgtttgctggctggtgagatcttccagcgacggctcgcgtccggctttcagtgcatcgacggcgttttccagcaactccatatacagcgagaaaccgatggtttccattgagccgctttgttcttcgccaagcagttcacccgcgccgcgaatctccagatcgtgcgttgccagcgcaaaacctgccccgagatcttccagcgaggcaattgcttcaagacgtttttgtgcatcggtagtcatcgcttttggatgcggtgtcagcaaccatgcatatgcctgatgatgcgaacgtccgacgcgaccgcgtaactggtgcagctgcgccagaccgaagtgatccgcgcgttcaatgataatagtgttggctgtcgggatgtcgatcccggtttcgataatggttgtacaaaccagcacgttgaaacgttgatgatggaaatcattcatcacccgttccagttcgcgctcgcgcatctgcccgtgaccgatggcgatccgcgcttctggcaccagttctgccagccgttcggcggctttctgaatgttttccacatcattgtagagataataaacctgtcctccgcgcaaaatttcacgcaggatcgcctcccggaccaccatgctgtcatactcacggacaaaggttttaactgccagacgacgggcgggcggcgtggcgataatcgacaggtcacgcattccgctcattgccatattcagcgtacgtgggatcggcgttgcagtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgcttgtggttatctactgccaggaaagctgcgcgcatcgccacttctgttttaccaaagccaacatcgccgcacaccagacgatccattgccagcggctgacacatgtcgctaagtaccgcattaatggcctgcgcctgatccggcgtggtttcaaacgggaagctgtcgcagaacaactgatactgctcacgatcgtgtttaaacgcgaagccctctttggcggcgcgttgcgcgtagatatccagcaattccgccgccacatcacgcactttttccgccgctttctgccgcgcgcgtgaccacgcatcgccgccaagtttatgcagcggggcgttttcttccgcgccacctgcgtaacggctaatcagatgcagtgacgacaccggaacatacagtttggcgtcgttggcataggtgagcatcagatactcgccagtaatgccacccgcttccagcgtggtcattccggcataacgaccgacgccgtgctccagatggaccaccggctgaccaatatgcagttccgcaaggttacggatcagtgtatcggggttgatggtgcggcgagaatcctgacgacgacgggcaacgcgttcaccgagcagatcgctttcgcaaatcagcgccagattacgcaccgtatcgacaaaaccatgttcggcagcgccaatcatcagataacgcccacggtcgctggcttcatcaagacgcataatgcgttgcggagcaattttaattcgtgcgagcagttcacccagcgcttcacggcgaccttcactttctaccgagaacaccaccggaccgtcgaaagtctcgaggaacttacgcagcgcatccagcggcgctttttgttgtgcctgaacggccaggtctggcagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccagcgtgtcagcctggaaacgttcggcactggtttccagatcgccagtattcacgagcaaggtattggcagggaaataactgaacagcggcggcagtggttcgctgaagaacaatggctgccagtactcgatcccggcaggtaatgtgcctttactcacttgctggtaaatatgttctggatcgcgcttcacttcgaaggtatcgcgccactggctgcggaacagttcaattgccgctttatcggtcggaaattcgtgcgcgggcagcagattgatcgcttctacttcctccagcgtgcgctggctgtcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctgaccttttttcatcaccagcgcatgaccgtggagaaaactgtgtgggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatttgatcggtaaactggctgatttcatcatgcaaacgcagagcattttgcatatctggtgcaatgagtaccaccggaccggcgtgacgttcggcaatttccgctaccagcgttgcacaggctgcgccggttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccatcagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtggcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccagaagatgttccagatccgtttatcgagacaatttccccacggtacgctgtcgatatagcggcgaatcaaatagccggatataaagaaaaaaaccggcatacgaaagggggcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgacccgaggtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccagaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcggatgcccaacaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggtgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccatcgttgaccctgacctggtcgtcattggtggtggcttatcgaatttcccggcaatcacaacgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagtgcgttgttcacaaagtggtcaggttctcgactggacaggagacgttaccccagaagataaatgccattgttgccagtttccggcacccttgcgcccgcacgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggacgcaattaattgaatttgcgggttttgtgggccggataaggcgttcgcgccccatccggaataatacacgcgcacttttccggcctcttttatcgtttactcgtcaataacaatgcggcaataaacgtacagacaccaattagccctgcccagagtggcgatattctggtaatcgcaaagctattatcgatatacaaacataaagcctgataacccatattggcaatagtcatcgccactgcaaattttaacgcataaataaaacgagtcgtgtagtaaaagatcctggaaaataagataaacgtcgcagcccaggcgataaaacctaatgtgttggtgctgccggggggagcattttcatgctgttgtcctggatgcggataatacgttagtggcggcgtcgattgttttaatatctgtgcttgtagaacagccaatgcattattgattccctgataccagagatctgcatttaaataagccagcgtgtgattttctatcagaaggccgagatgtttatcgtccagaccactttcaacctggccgttggtgatcataattaaccgtggttcgcgggtagtaaatagtaacagaacacttccttttacatcactcaatgaagatgacgcatgcgccagcatcgctttaccattttgtctgagactggcttcattattaatgtcgggtaaaaccacaataaacggtgcaattcccgtttgttggcgaaaaagctcggctttatgcgcgatctcttcagcatctggtacagtaccggtaacgtccgtaaaaagtgtcttcattattggaattaatggcttgctggctgctgtcagaggcaggagtatcagtaaactgagcagtataatgaattttttcatgggcgggacttccgtttcctgcgtgattttttagaggagggcatacttattaataaaccgacggcgataaaaataacgcccataatgccgataaacccccatttaaaaaaattaacccacgggttatttatctcagccttttcaggatgcccgggagaataataaacattaactttatcgccttcgctgtcttcataaaaatcgctgccgatactcgaattgaaaattagcgtgtaatctggcgtcggtcgaaaggcaacgacgggataccacgaaccatctttacccgtgcgatgagaatgactggagtgccagacggtatcaacaatgacgccttcggtatgaatcgcgtctttgctataggtgaactggttataaaagacaacaacagaaatgaggatcagtaccagaccgataccgaggaatatacgaaagaaaactttactgtcctgactcattagccacatccttgctaactaaaaaacgggcggtaataccaccgcccgcttgctgaattaacgtcctgctttcagcttctgataatactcttcataaatgctgctggctgcgccaacgtcattctgccattcgccatttttaatggtttcagcatccgggtagagtgttttatcgttcgccacttctggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctggcgtgcaacgaaagcagaaccgttccagatcatgccgaggttaacttcgccttccatgtacgggttcgccgggttatcggagttaaaggctgccacgtttggcatcagttttttcagctcgttatatgcagcttcaatctctttcggatcggtggtgttaccggagtagcccagcttacgcagcgccatctggaacacttcacgggcatcgtcggtcaacagcaggctgcctttgtactctggcttccacagatcggcccagctggtgacagatttcggatccaccgcatcaccgttaacaccaatcgccgtcgcaccccagatatacggaatggagtagtcgttattcgggtcaaaaggcttgttgagcatgtctggatcgagattgctgaagtttgttaacttcgacttgtcgatcttctggatcatcccttctttacgcattttatcaacgtaataggttgaaggaaccaccagatcataggcaccgtctttgtatgttttcagcttggcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcataacttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcattcgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaagccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcaaacgagaagcgcgccagtaaaccagcaacatcaggcccattacgatagtcagcgtaatgctggtagctgcaccaaacggccagtcacgaatattaaggaactggaccttgatgacgttaccgatcagcaggtttttcgcaccgcccatcaggtcggatacatagaacaggcccatcgctggcagcatcaccagcagacatccggcaataattcccggcatcgtcagtggaataatgatacggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaattaatgagttggtccagaacggaacaatcagcagaaacagcagcagcggacgcaccttgtgtggcaacttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacaaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattc

SEQ ID NO: 81 - protein, 370 aa, Artificial Sequence; identical to SEQ ID NO: 23
  Description of Artificial Sequence; note = synthetic construct

SEQ ID NO: 82 - DNA, 15295 bp, Artificial Sequence
  Description of Artificial Sequence; note = synthetic construct
gatcatccacggagccgagtctggcgtcgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtgggtgattgtaacgggcataggttaaataaaacttaaagaaagcgtagctatactcgtaataatgtaagaatgtgcttaaccgtggtttcagctacaaaattcgctttctcgttagctgcgcttttattaaactctgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgaccgcgtatctggcgggcgggatgtttttacaatggctgctggggccgctgtcggatcgtattggtcgccgtccggtgatgctggcgggagtggtgtggtttatcgtcacctgtctggcaatattgctggcgcaaaacattgaacaattcaccctgttgcgcttcttgcagggcataagcctctgtttcattggcgctgtgggatacgccgcaattcaggaatccttcgaagaggcggtttgtatcaagatcaccgcgctgatggcgaacgtggcgctgattgctccgctacttggtccgctggtgggcgcggcgtggatccatgtgctgccctgggaggggatgtttgttttgtttgccgcattggcagcgatctcctttttcggtctgcaacgagccatgcctgaaaccgccacgcgtataggcgagaaactgtcactgaaagaactcggtcgtgactataagctggtgctgaagaacggccgctttgtggcgggggcgctggcgctgggattcgttagtctgccgttgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctattggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtttctgccgcgatgggaatgctgcaaatgctgatctttaccgttggtattgaaatcagcaaacatgcctggctgaacgggggcaacggactgtttaatctcttcaaccttgtcaacggaattttgtggctgtcgctgatggttatctttttaaaagataaacagatgggaaattctcacgaagggtaaaaaaatgcctgactgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgaccgcttgtggaacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggcattgtgttgccgggcgtgctgccggttttattggtcaaatggcgcttcgtgtttaagaactttatcgatcacatccagtacgccttcacggttattggagcctgcgcggtattttgccgctgcgacgaccgcgctaccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggaccgacaccataatatcgccgatggcctcatgtaatgctttttgtacttgtggaatcagttcatcggaaagattcaggccaaacttaaagaagatatcctctaagttgtcaaagttatcgacgtattccagacggtgataatacatttccgccaccgttttcatggcatcgtcatattttttgagtgtataggcactattttttccgcaggcaataatttccacttccgggcgcgtcagcaaatgttccacgacagtagcaaacgcatccttcgatagctcgccattaaaaacatctttgccttcgctcactacccagccgccgttttcagccacaaaggcaatttcattagcaatttcagggaagaaagagatcaactgataatattgattcccgctggcgactacaaagcgaattccttgtgctttcatttgctgatactgagccataaaccgctcacggttataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgttgctaccacactgacgcgggttggtgcatcggggccggtatcgctggcggcagaaatggtcagcgggaagcccagcgaggcacccagtccccagagtacaacagacaccccagcgacccaggcgctatcgacaaaaataatcagcccaatacccaacgcccccattagtgcactggcccgaaccacggcaacgcgactgtaacggtcgatgaaccaaccgccggtgaagcgtccaacggtcatccccagggtaaaaccggcataaatcagcgagccggaagtagggctaaaaccgtgaccgtcaaccattaataagggtaaccagtcgttggcagaaccttcggcaaaggccatcgccagcaccacaacacctatcagcagcaactggatatcgcgataaaaaggtacgcctttttcgccatgctgggtgccatcggcagcatttttgcccgtaccgtcagggattgcctgaatggcgatataaataggtgcgatacctaccagcgccgccaataaaatgtgcaccgttgccggaacgccaaaggccgtcagtgccatcccgacacctgcgcctgccagcgtgcccaggctataaaaaccgtgcatcatcggcaaaaccgtcttattcatttctcgctcaacggcagcaccttcaacgtttatcgccacttccgcagaaccaaaacttgccccaaagacgccgagaccaacggcaaagagcaggggcgatgtcagccagagtgccagacttaatatcatcatcccgatcaatgcgcaggacatcgtgaccaggatgacattacgtgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagatcacgtcaaaataagaagagggaagacaacattagcaaggttgtgtacatttgtacacaattgcagagagaggaaatgacatgcgtcgcgctaacgatccgcaacggcgagaaaaaattatccaggccacgctggaggcggtgaaactttacggaatacatgctgttacgcaccgcaaaattgctacccttgccggggtaccgttgggatcgatgacctactatttttcaggaattgatgagttgttactggaggcgttcagcagttttactgagatcatgtcccggcaatatcaggcattttttagcgatgttagtgatgctccgggcgcatgccaggctatcaccgatatgatctacagctcacaggttgcaacgccggataacatggagctgatgtaccagctctacgcgctggctagccgaaaaccgctattaaaaacggtaatgcaaaactggatgcagcgcagtcagcaaacgctcgaacaatggtttgaacccggaaccgcccgcgcgcttgatgcgtttattgaggggatgacgctgcattttgtcaccgaccgtaagccgctatcgcgcgaggagattttgaggatggttgagagggttgcagggtagtagataagttttagataacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcagaatgccagcaggtcagtgacctggctgtgaatcgagataaagccgatgcgatcggcgatggtttttacgcggcgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagttccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttactaagcgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactgaaaatcatcgcgttcattgctcaatttctcagccagatcttttgcacgcacacagtaagggcaacccgaacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagcgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaggtgaatgcgtcgccggggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgatgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatatgcataaaaatttgttaaataccgttttttaatccgagctatagtctcaaaccctggctaaagttattcttgcgatgcttttatatagcgagcagtgctggccgggagaaagttctcttttcttacaccgcgccgataaaaaatatgcacgtttattgcatatctttcagtgtgacaacttttgttcgtttgttaacgaactttcagaaggaaagagatatgaccgccttaaataaaaaatggctatcgggtctggttgcgggtgctctgatggccgtctctgtcggcacgctcgcggctgaacaaaaaacactccacatttataactggtctgattatatcgccccggacacggtggccaattttgaaaaagaaaccggtattaaagtcgtctacgatgttttcgactctaacgaagtactggaaggcaaattaatggccgggagtaccggctttgatctggtggttccatctgccagctttctggagcgccagttgactgcgggagttttccagccgctggacaaaagcaaattgccggagtggaagaatctcgacccggaactgctgaagctggtcgccaaacacgatcccgacaataaatttgctatgccctatatgtgggcgacgaccgggattggctataacgttgataaagttaaagcggtgctgggcgaaaacgcgcccgtcgatagctgggacttgatcctcaaacctgaaaatctggaaaaactgaaaagctgcggtgtctctttcctggatgcgccagaagaagtttttgctaccgtgttgaattatctcggcaaagatcccaacagcactaaagcggatgattacaccggaccggcaacagatctgctgttaaagctgcgcccgaacattcgttatttccattcatctcaatacattaacgacctggcaaacggcgatatttgcgtcgctatcggctgggcaggtgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgcccggatgtagtagcgcatatttccgaccatgtgttctatgccaacgccaataaagcagccacgccgctggtgagtgcggaagtccgtgagaacccaggtatttatccgcctgcggatgttcgtgcgaagctgttcactctgaaagtgcaggatccgaaaatcgaccgtgtgcgcacccgcgcgtggaccaaagtgaagagcggaaaataatccgcagtcgtagatgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctggcggagatggcgcgcgctattccaccttataccgaactgatggagtgggctgacgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctatggcaagagtttttcaataaccgcgactggccggtggcctcggcggtagcgatcatcatgttgctgctgctaattgtgccgataatgtggttccacaaacaccagcaaaaaagcgtgggagaacacggatgaataatttaccggtagttcgttcgccctggcggattgtgattttgctgctgggctttacctttctctacgcgccaatgctgatgctggttatctattcgtttaacagctcgaagctggtgacggtgtgggccggctggtcaacgcgctggtatggtgagttattgcgcgatgacgcgatgatgagtgcggttggtttaagtctgacaattgcggcctgtgcggcgacggcggcggcgatcctcggaactattgcggcggtggtgctggtgcgctttggcaggtttcgcggatcaaatggctttgcctttatgatcaccgcgccgctggtaatgccagatgtcatcacgggcttgtcgctgttgttattattcgtcgcgcttgctcatgccattggctggcctgcggaccgcggtatgctcaccatctggctggcgcatgtcactttttgtacggcttatgtggcggtcgttatttcttcaagattgcgggaactggatcgctcgatagaagaagcagcgatggatctcggtgcgacgccgctgaaagtgtttttcgtcattacgctaccgatgatcatgcccgcgatcatttctggctggttactggcttttactttgtcgcttgatgatctggtgatcgccagctttgtttccgggccgggagccaccacgttaccgatgctggtcttttccagcgtgcggatgggggtgaatccggaaatcaacgccctggcaacattgatcctcggcgcggtcggaattgtcggatttatcgcctggtatctgatggctcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggttttcattgagatctggtgtgcgttttcactggtgaaagggcgtcgctgggcgcgctggctatatctgctgacacaaatcaccgccgcaagttacttgtgggcggcttcgctggggtacggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataatgcagccgattccagagcaactctccgctaaaaccgccgatc

SEQ ID NO: 83 - DNA, 14631 bp, Artificial Sequence
  Description of Artificial Sequence; note = synthetic construct
ccccgcggcaggccctccgagcgtggtggagccgttctgtgagacagccgggtacgagtcgtgacgctggaaggggcaagcgggtggtgggcaggaatgcggtccgccctgcagcaaccggagggggagggagaagggagcggaaaagtctccaccggacgcggccatggctcgggggggggggggcagcggaggagcgcttccggccgacgtctcgtcgctgattggcttcttttcctcccgccgtgtgtgaaaacacaaatggcgtgttttggttggcgtaaggcgcctgtcagttaacggcagccggagtgcgcagccgccggcagcctcgctctgcccactgggtggggcgggaggtaggtggggtgaggcgagctggacgtgcgggcgcggtcggcctctggcggggcgggggaggggagggagggtcagcgaaagtagctcgcgcgcgagcggccgcccaccctccccttcctctgggggagtcgttttacccgccgccggccgggcctcgtcgtctgattggctctcggggcccagaaaactggcccttgccattggctcgtgttcgtgcaagttgagtccatccgccggccagcgggggcggcgaggaggcgctcccaggttccggccctcccctcggccccgcgccgcagagtctggccgcgcgcccctgcgcaacgtggcaggaagcgcgcgctgggggcggggacgggcagtagggctgagcggctgcggggcgggtgcaagcacgtttccgacttgagttgcctcaagaggggcgtgctgagccagacctccatcgcgcactccggggagtggagggaaggagcgagggctcagttgggctgttttggaggcaggaagcacttgctctcccaaagtcgctctgagttgttatcagtaagggagctgcagtggagtaggcggggagaaggccgcacccttctccggaggggggaggggagtgttgcaatacctttctgggagttctctgctgcctcctggcttctgaggaccgccctgggcctgggagaatcccttccccctcttccctcgtgatctgcaactccagtctttctagccttaattaagggatctgtagggcgcagtagtccagggtttccttgatgatgtcatacttatcctgtcccttttttttccacagctcgcggttgaggacaaactcttcgcggtctttccagtggggatcgacggtatcgtagagtcgaggccgctctagaactagtggatccggaacccttaatataacttcgtataatgtatgctatacgaagttattaggtccctcgacctgcaggaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagccaatatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagaagcttgcagatctgcgactctagaggatctgcgactctagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgcgactctagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgcgactctagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccccatcaagctgatccggaacccttaatataacttcgtataatgtatgctatacgaagttattaggtccctcgaggtgcagcccaagctagaggatccccgggtccggtcgccaccatgccagatgatccgcggctcctggaattcggcttggggatatccaccatggagacagacacactcctgctatgggtactgctgctctgggttccaggttccactggtgactatccatatgatgttccagattatgctggggcccagccgacgccaatgaaaataaaaacaggtgcacgcatcctcgcattatccgcattaacgacgatgatgttttccgcctcggctctcgccaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcgaaagagttcctcgaaaactatctgctgactgatgaaggtctggaagcggttaataaagacaaaccgctgggtgccgtagcgctgaagtcttacgaggaagagttggcgaaagatccacgtattgccgccaccatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctctgagctcgacgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttaggcggccgctcgagatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatcggcgcgccggctagaagatgggcgggagtcttctgggcaggcttaaaggctaacctggtgtgtgggcgttgtcctgcaggggaattgaacaggtgtaaaattggagggacaagacttcccacagattttcggttttgtcgggaagttttttaataggggcaaataaggaaaatgggaggataggtagtcatctggggttttatgcagcaaaactacaggttattattgcttgtgatccgcctcggagtattttccatcgaggtagattaaagacatgctcacccgagttttatactctcctgcttgagatccttactacagtatgaaattacagtgtcgcgagttagactatgtaagcagaattttaatcatttttaaagagcccagtacttcatatccatttctcccgctccttctgcagccttatcaaaaggtattttagaacactcattttagccccattttcatttattatactggcttatccaacccctagacagagcattggcattttccctttcctgatcttagaagtctgatgactcatgaaaccagacagattagttacatacaccacaaatcgaggctgtagctggggcctcaacactgcagttcttttataactccttagtacactttttgttgatcctttgccttgatccttaattttcagtgtctatcacctctcccgtcaggtggtgttccacatttgggcctattctcagtccagggagttttacaacaatagatgtattgagaatccaacctaaagcttaactttccactcccatgaatgcctctctcctttttctccatttataaactgagctattaaccattaatggtttccaggtggatgtctcctcccccaatattacctgatgtatcttacatattgccaggctgatattttaagacattaaaaggtatatttcattattgagccacatggtattgattactgcttactaaaattttgtcattgtacacatctgtaaaaggtggttccttttggaatgcaaagttcaggtgtttgttgtctttcctgacctaaggtcttgtgagcttgtattttttctatttaagcagtgctttctcttggactggcttgactcatggcattctacacgttattgctggtctaaatgtgattttgccaagcttcttcaggacctataattttgcttgacttgtagccaaacacaagtaaaatgattaagcaacaaatgtatttgtgaagcttggtttttaggttgttgtgttgtgtgtgcttgtgctctataataatactatccaggggctggagaggtggctcggagttcaagagcacagactgctcttccagaagtcctgagttcaattcccagcaaccacatggtggctcacaaccatctgtaatgggatctgatgccctcttctggtgtgtctgaagaccacaagtgtattcacattaaataaataaatcctccttcttcttcttttttttttttttaaagagaatactgtctccagtagaatttactgaagtaatgaaatactttgtgtttgttccaatatggtagccaataatcaaattactctttaagcactggaaatgttaccaaggaactaatttttatttgaagtgtaactgtggacagaggagccataactgcagacttgtgggatacagaagaccaatgcagactttaatgtcttttctcttacactaagcaataaagaaataaaaattgaacttctagtatcctatttgtttaaactgctagctttacttaacttttgtgcttcatctatacaaagctgaaagctaagtctgcagccattactaaacatgaaagcaagtaatgataattttggatttcaaaaatgtagggccagagtttagccagccagtggtggtgcttgcctttatgcctttaatcccagcactctggaggcagagacaggcagatctctgagtttgagcccagcctggtctacacatcaagttctatctaggatagccaggaatacacacagaaaccctgttggggaggggggctctgagatttcataaaattataattgaagcattccctaatgagccactatggatgtggctaaatccgtctacctttctgatgagatttgggtattattttttctgtctctgctgttggttgggtcttttgacactgtgggctttctttaaagcctccttcctgccatgtggtctcttgtttgctactaacttcccatggcttaaatggcatggctttttgccttctaagggcagctgctgagatttgcagcctgatttccagggtggggttgggaaatctttcaaacactaaaattgtcctttaattttttttttaaaaaatgggttatataataaacctcataaaatagttatgaggagtgaggtggactaatattaaatgagtccctcccctataaaagagctattaaggctttttgtcttatacttaactttttttttaaatgtggtatctttagaaccaagggtcttagagttttagtatacagaaactgttgcatcgcttaatcagattttctagtttcaaatccagagaatccaaattcttcacagccaaagtcaaattaagaatttctgacttttaatgttaatttgcttactgtgaatataaaaatgatagcttttcctgaggcagggtctcactatgtatctctgcctgatctgcaacaagatatgtagactaaagttctgcctgcttttgtctcctgaatactaaggttaaaatgtagtaatacttttggaacttgcaggtcagattcttttataggggacacactaagggagcttgggtgatagttggtaaaatgtgtttcaagtgatgaaaacttgaattattatcaccgcaacctactttttaaaaaaaaaagccaggcctgttagagcatgcttaagggatccctaggacttgctgagcacacaagagtagttacttggcaggctcctggtgagagcatatttcaaaaaacaaggcagacaaccaagaaactacagttaaggttacctgtctttaaaccatctgcatatacacagggatattaaaatattccaaataatatttcattcaagttttcccccatcaaattgggacatggatttctccggtgaataggcagagttggaaactaaacaaatgttggttttgtgatttgtgaaattgttttcaagtgatagttaaagcccatgagatacagaacaaagctgctatttcgaggtctcttggtttatactcagaagcacttctttgggtttccctgcactatcctgatcatgtgctaggcctaccttaggctgattgttgttcaaataaacttaagtttcctgtcaggtgatgtcatatgatttcatatatcaaggcaaaacatgttatatatgttaaacatttgtacttaatgtgaaagttaggtctttgtgggtttgatttttaattttcaaaacctgagctaaataagtcatttttacatgtcttacatttggtggaattgtataattgtggtttgcaggcaagactctctgacctagtaaccctacctatagagcactttgctgggtcacaagtctaggagtcaagcatttcaccttgaagttgagacgttttgttagtgtatactagtttatatgttggaggacatgtttatccagaagatattcaggactatttttgactgggctaaggaattgattctgattagcactgttagtgagcattgagtggcctttaggcttgaattggagtcacttgtatatctcaaataatgctggccttttttaaaaagcccttgttctttatcaccctgttttctacataatttttgttcaaagaaatacttgtttggatctccttttgacaacaatagcatgttttcaagccatattttttttcctttttttttttttttttggtttttcgagacagggtttctctgtatagccctggctgtcctggaactcactttgtagaccaggctggcctcgaactcagaaatccgcctgcctctgcctcctgagtgccgggattaaaggcgtgcaccaccacgcctggctaagttggatattttgttatataactataaccaatactaactccactgggtggatttttaattcagtcagtagtcttaagtggtctttattggcccttcattaaaatctactgttcactctaacagaggctgttggtactagtggcacttaagcaacttcctacggatatactagcagattaagggtcagggatagaaactagtctagcgttttgtatacctaccagctttatactaccttgttctgatagaaatatttcaggacatctcagcttatcgatccgtcgacggtatcgataagcttgatatcgaattctaccgggtaggggaggcgcttttccaaggcagtctgagcatgcgcttagcagccccgctggcacttggcgctacacaagtggccttggcctcgcacacattccacatccaccggtaggcgccaaccggctccgttctttggtggccccttcgcgccaccttctactcctcccctagtcaggaagttcccccccgccccgcagctcgcgtcgtgaggacgtgacaaatggaagtagcacgtctcactagtctcgtcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcaggtcctcgccatggatcctgatgatgttgttattcttctaatcttttgtatggaaaacttttcttcgtaccacgggactaaacctggttatgtagattccattcaaaaaggtatacaaaagccaaaatctggtacacaaggaaattatgacgatgattggaaagggttttatagtaccgacaataaatacgacgctgcgggatactctgtagataatgaaaacccgctctctggaaaagctggaggcgtggtcaaagtgacgtatccaggactgacgaaggttctcgcactaaaagtggataatgccgaaactattaagaaagagttaggtttaagtctcactgaaccgttgatggagcaagtcggaacggaagagtttatcaaaaggttcggtgatggtgcttcgcgtgtagtgctcagccttcccttcgctgaggggagttctagcgttgaatatattaataactgggaacaggcgaaagcgttaagcgtagaacttgagattaattttgaaacccgtggaaaacgtggccaagatgcgatgtatgagtatatggctcaagcctgtgcaggaaatcgtgtcaggcgatctctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcagatcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgacctcgagggggggcccggtacccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagct

SEQ ID NO: 84 - protein, 2224 aa, Artificial Sequence
  Description of Artificial Sequence; note = synthetic construct
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 85 - protein, 466 aa, Artificial Sequence
  Description of Artificial Sequence; note = synthetic construct
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 86 - protein, 2351 aa, Artificial Sequence
  Description of Artificial Sequence; note = synthetic construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 87 - protein, 488 aa, Artificial Sequence
  Description of Artificial Sequence; note = synthetic construct
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 88 - protein, 752 aa, Artificial Sequence
  Description of Artificial Sequence; note = synthetic construct
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 89 - protein, 1663 aa, Artificial Sequence
  Description of Artificial Sequence; note = synthetic construct
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 90 - protein, 638 aa, Artificial Sequence
  Description of Artificial Sequence; note = synthetic construct
MDLWRVFLTLALAVSSDMFPGSGATPATLGKASPVLQRINPSLRESSSGKPRFTKCRSPELETFSCYWTEGDDHNLKVPGSIQLYYARRIAHEWTPEWKECPDYVSAGANSCYFNSSYTSIWIPYCIKLTTNGDLLDEKCFTVDEIVQPDPPIGLNWTLLNISLPGIRGDIQVSWQPPPSADVLKGWIILEYEIQYKEVNETKWKTMSPIWSTSVPLYSLRLDKEHEVRVRSRQRSFEKYSEFSEVLRVTFPQMDTLAACEEDFRFPWFLIIIFGIFGVAVMLFVVIFSKQQRIKMLILPPVPVPKIKGIDPDLLKEGKLEEVNTILGIHDNYKPDFYNDDSWVEFIELDIDDADEKTEESDTDRLLSDDQEKSAGILGAKDDDSGRTSCYDPDILDTDFHTSDMCDGTSEFAQPQKLKAEADLLCLDQKNLKNSPYDASLGSLHPSITLTMEDKPQPLLGSETESTHQLPSTPMSSPVSLANIDFYAQVSDITPAGGVVLSPGQKIKAGLAQGNTQLEVAAPCQENYSMNSAYFCESDAKKCIAAAPHMEATTCVKPSFNQEDIYITTESLTTTARMSETADTAPDAEPVPDYTTVHTVKSPRGLILNATALPLPDKKKFLSSCGYVSTDQLNKIMQ

SEQ ID NO: 91 - DNA, 2950 bp, Artificial Sequence
  Description of Artificial Sequence; note = synthetic construct
gaattccggagagaccacaagatagaggattattaatttatggggattttttggagatttatatacccaagcaacaactcctagatgctacagaccaagacaccaagaaataaccacgaaattctactttcaaccctagcttctctaccagattttaactaaacaagatcttcttgcaaaggtctcaggtatggatctttggcgggtgttcttaaccctggcactggcagtctccagcgacatgtttcctggaagtggggctacaccagctactcttggcaaagcttccccggttctgcaaagaattaatccaagcctgagggaaagttcctctggaaagcctcgattcaccaagtgtcgttcccctgaactggagaccttttcatgctactggacagaaggggatgatcataatttaaaggtcccgggatctattcagctatactatgctagaagaattgctcatgaatggaccccggaatggaaagaatgccctgattatgtctctgctggagcaaacagctgttacttcaactcatcgtatacctccatttggataccctactgcattaagcttactacaaatggtgatttgttggacgaaaagtgtttcactgttgatgaaatagtgcaacctgatccgcccattggcctcaactggactttactaaacatcagtttgcctgggatccgtggagatatccaagtgagttggcagccaccgcccagtgccgatgttctgaagggatggataattctggagtatgaaattcagtacaaagaagtaaatgaaacaaaatggaaaacgatgagcccgatatggtcaacatcagtcccactgtactcactgagactggataaagagcacgaagtgcgtgtgagatccagacaacggagcttcgaaaagtacagcgagttcagtgaagtactccgtgtaacgtttcctcagatggacacactggcagcatgtgaagaagatttccggtttccatggttcttaattattatctttggaatatttggagtagcagtgatgctatttgtagttatattttcaaagcagcaaaggattaagatgctgattttacccccagtaccagttccaaagattaaagggattgatccagatcttctcaaggaaggaaaattggaggaggtgaacaccatcttgggcattcatgataactacaaacccgacttctacaatgatgactcctgggttgagttcattgagctggatattgatgatgcggatgagaagactgaagagtcagacaccgacagacttctaagcgatgaccaggagaaatcagctggtatccttggagcaaaggatgacgattctggacgtaccagctgttatgaccctgacattttggataccgatttccacaccagtgacatgtgcgatggtacctcggagtttgctcagccgcagaagttaaaagcagaagctgatctcttgtgccttgaccagaagaatctgaagaactcgccttatgatgcttcccttggctctctgcacccctccattaccctgacaatggaagacaaaccacagccacttctgggcagtgaaactgagtcaacccaccaactcccctctacaccaatgagcagtcccgtgtcactggcaaacattgacttttatgcccaagtaagcgacattacaccagcaggtggtgtagtcctttctccaggccaaaagattaaggcagggttagcccagggcaacacccagctggaggtggccgcgccctgccaagaaaattacagcatgaacagtgcctacttctgtgagtcagatgccaaaaagtgcatcgctgcggcccctcacatggaggccacgacatgtgtaaaaccaagctttaaccaagaggacatttacatcaccacagaaagccttaccactactgcccgaatgtccgagacagcagataccgctccagatgctgagcctgtcccagactacaccacggttcacaccgtgaagtccccaaggggccttatactcaacgcgactgctttgcctttgcctgacaaaaagaagtttctctcctcatgtggctatgtgagcacagaccaactgaacaaaatcatgcagtagcctttcctatctttaatggcaaaagaaatgactgggcacgaacgcctaaaccaaaactatgttttaaatctgtgttgggagagcgtgagagtgaatgtggattcaaaaataccttttctggaaacgtcgaaacattatcataacgtggaaaatcaagaatatgtaatcagatagatactcccattgtgaattttaaatattttaagatcgtctttaagactgtttgtggcagtgattgtctgtgctgtgggtcttaactttgtgatactaagttattaaatagctacgtttttcatgtatgtagatcattgctttttttgaaaaagcaaaacaatcaggtggcttttgcagttcaggaaattgaatgcagattttagcacagactgatttctttttcctttttaaatagctaggagctaaaactctaggggagaaggtaaaactagtttggatatgcaaaacatttattttgacataaaattgataaagatatttttaataatttacactgtaagcatgagtattttataatacactacagatatattgttagttcacaacaatccatctacggatgtaacaactacaatgtgtagaggggttgatgctttggtcaatgaacctaaagaaaaatgaacaagttagatttttacaaagcccttttttataactcccaaaacttcttaaatctaaaaatgtctgcattattggaacaaacccattttaaatttgtaaatgaatatttttttaattttgaaaactttaattttttatacaaattaacgtatcatacaccaaacagtaacagaagtgattataataatggaagaaacagtttcttcc

SEQ ID NO: 92 - protein, 1370 aa, Artificial Sequence
  Description of Artificial Sequence; note = synthetic construct
MKSGSGGGSPTSLWGLVFLSAALSLWPTSGEICGPGIDIRNDYQQLKRLENCTVIEGFLHILLISKAEDYRSYRFPKLTVITEYLLLFRVAGLESLGDLFPNLTVIRGWKLFYNYALVIFEMTNLKDIGLYNLRNITRGAIRIEKNADLCYLSTIDWSLILDAVSNNYIVGNKPPKECGDLCPGTLEEKPMCEKTTINNEYNYRCWTTNRCQKMCPSVCGKRACTENNECCHPECLGSCHTPDDNTTCVACRHYYYKGVCVPACPPGTYRFEGWRCVDRDFCANIPNAESSDSDGFVIHDGECMQECPSGFIRNSTQSMYCIPCEGPCPKVCGDEEKKTKTIDSVTSAQMLQGCTILKGNLLINIRRGNNIASELENFMGLIEVVTGYVKIRHSHALVSLSFLKNLRLILGEEQLEGNYSFYVLDNQNLQQLWDWNHRNLTVRSGKMYFAFNPKLCVSEIYRMEEVTGTKGRQSKGDINTRNNGERASCESDVLRFTSTTTWKNRIIITWHRYRPPDYRDLISFTVYYKEAPFKNVTEYDGQDACGSNSWNMVDVDLPPNKEGEPGILLHGLKPWTQYAVYVKAVTLTMVENDHIRGAKSEILYIRTNASVPSIPLDVLSASNSSSQLIVKWNPPTLPNGNLSYYIVRWQRQPQDGYLFRHNYCSKDKIPIRKYADGTIDVEEVTENPKTEVCGGDKGPCCACPKTEAEKQAEKEEAEYRKVFENFLHNSIFVPRPERRRRDVLQVANTTMSSRSRNTTVADTYNITDPEEFETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVPAKTTYENFMHLIIALPVAILLIVGGLVIMLYVFHRKRNNSRLGNGVLYASVNPEYFSAADVYVPDEWEVAREKITMNRELGQGSFGMVYEGVAKGVVKDEPETRVAIKTVNEAASMRERIEFLNEASVMKEFNCHHVVRLLGVVSQGQPTLVIMELMTRGDLKSYLRSLRPEVENNLVLIPPSLSKMIQMAGEIADGMAYLNANKFVHRDLAARNCMVAEDFTVKIGDFGMTRDIYETDYYRKGGKGLLPVRWMSPESLKDGVFTTHSDVWSFGVVLWEIATLAEQPYQGLSNEQVLRFVMEGGLLDKPDNCPDMLFELMRMCWQYNPKMRPSFLEIIGSIKDEMEPSFQEVSFYYSEENKPPEPEELEMELELEPENMESVPLDPSASSASLPLPERHSGHKAENGPGVLVLRASFDERQPYAHMNGGRANERALPLPQSSTC

SEQ ID NO: 93 - DNA, 4696 bp, Artificial Sequence
  Description of Artificial Sequence; note = synthetic construct
tttttttttttttgagaaaagggaatttcgtcccaaataaaaggaatgaagtctggctccggaggagggtccccgacctcgctgtgggggctcgtgtttctctccgccgcgctctcgctctggccgacgagtggagaaatttgtgggcccggcattgacatccgcaacgactatcagcagctgaagcgcctggaaaactgcacggtgatcgagggcttcctccacatcctgctcatctccaaggccgaggactaccgaagctaccgcttccccaagctcacagtcatcaccgagtacttgctgctgtttcgagtggccggcctcgagagcctgggagacctcttcccgaacctcacagtcatccgtggctggaaactcttctacaattacgcactggtcatcttcgagatgaccaatctcaaggatattgggctttataatctgaggaacattactcggggggccatcaggattgagaaaaacgctgacctctgttacctctccaccatagactggtctctcatcttggatgcggtgtccaataactacattgtggggaacaagcccccaaaggaatgtggggacctgtgtccagggaccttggaggagaagcccatgtgtgagaagaccaccatcaacaatgagtacaactaccgctgctggaccacaaatcgctgccagaaaatgtgcccaagtgtgtgtgggaagcgagcctgcaccgagaacaatgagtgctgccacccggagtgcctaggcagctgccacacaccggacgacaacacaacctgcgtggcctgccgacactactactacaaaggcgtgtgcgtgcctgcctgcccgcctggcacctacaggttcgagggctggcgctgtgtggaccgggatttctgcgccaacatccccaacgccgagagcagtgactcagatggcttcgtcatccacgatggcgagtgcatgcaggagtgtccatcaggcttcatccgcaacagcacccagagcatgtactgtatcccctgtgaaggcccctgccccaaggtctgcggcgatgaagaaaagaaaacgaaaaccatcgattctgtgacgtctgcccagatgctccaagggtgcaccattttgaagggcaatctgcttattaacatccggcgaggcaataacattgcctcggaattggagaacttcatggggctcatcgaggtggtgactggctacgtgaagatccgccattcccatgccttggtctccttgtccttcctgaagaaccttcgtctcatcttaggagaggagcagctagaaggaaactactccttctatgtcctggacaaccagaacttgcagcagctgtgggactggaaccaccggaacctgaccgtcaggtcagggaaaatgtacttcgctttcaatcccaagctgtgtgtctctgaaatttaccgaatggaggaggtgacaggaacaaagggacggcagagcaaaggagacataaacaccaggaacaacggagagcgagcttcctgtgaaagtgatgttctccgtttcacctccaccaccacctggaagaaccgcatcatcataacgtggcaccggtaccggccgccggactaccgggatctcatcagtttcacagtctactacaaggaggcaccctttaaaaacgtcacggaatacgacgggcaggatgcctgtggctccaacagctggaacatggtggacgtggacctgcctccgaacaaggagggggagcctggcattttgctgcatgggctgaagccctggacccagtatgcagtctatgtcaaggctgtgaccctcaccatggtggaaaacgaccacatccgtggggccaaaagtgaaatcttgtacattcgcaccaacgcttcagttccttccattcctctagatgtcctctcggcatcaaactcctcctctcagctgatcgtgaagtggaaccccccaactctgcccaatggtaacttgagttactacattgtgaggtggcagcggcagccgcaggatggctatctgttccggcacaactactgctccaaagacaaaatacccatcagaaagtacgccgatggtaccatcgatgtggaggaggtgacagaaaatcccaagacagaagtctgcggtggtgataaagggccgtgctgtgcctgtcctaaaaccgaagctgagaagcaggctgagaaggaggaggctgagtaccgtaaagtctttgagaatttccttcacaactccatctttgtgcccagacctgagaggaggcggagagatgtcctgcaggtggctaacaccaccatgtccagccgaagcaggaacaccacggtagctgacacctacaatatcacagacccggaagagttcgagacagaataccctttctttgagagcagagtggataacaaggagaggactgtcatttccaacctccggcctttcactctgtaccgtatcgatatccacagctgcaaccacgaggctgagaagctgggctgcagcgcctccaactttgtctttgcaagaaccatgccagcagaaggagcagatgacattcctggcccagtgacctgggagccaagacctgaaaactccatctttttaaagtggccagaacccgagaaccccaacggattgattctaatgtatgaaataaaatacggatcgcaagtcgaggatcagcgggaatgtgtgtccagacaggagtacaggaagtatggaggggccaaacttaaccgtctaaacccagggaactatacggcccggattcaggctacctccctctctgggaatgggtcgtggacagatcctgtgttcttctatgtcccagccaaaacaacgtatgagaatttcatgcatctgatcattgctctgccggttgccatcctgctgattgtggggggcctggtaatcatgctgtatgtcttccatagaaagaggaataacagcagattgggcaacggggtgctgtacgcctctgtgaaccccgagtatttcagcgcagctgatgtgtacgtgcctgatgaatgggaggtagctcgggagaagatcaccatgaaccgggagctcggacaagggtccttcgggatggtctatgaaggagtggccaagggcgtggtcaaggacgagcctgaaaccagagtggccatcaagacagtgaatgaggctgcaagtatgcgtgagagaattgagtttctcaacgaggcctcagtgatgaaggagttcaactgtcaccatgtggtccggttgctgggtgtagtatcccaaggccagcccaccctggtcatcatggaactaatgacacgtggcgatctcaaaagttatctccggtctctaaggccagaggtggagaataatctagtcctgattcctccgagcttaagcaagatgatccagatggctggagagattgcagatggcatggcctacctcaatgccaacaagttcgtccacagagacctggctgctcggaactgcatggtagctgaagatttcacagtcaaaattggagattttggtatgacacgagacatctacgagacggactactaccggaaaggcgggaagggcttgctgcctgtgcgctggatgtctcccgagtccctcaaggatggcgtcttcaccactcattccgatgtctggtcctttggggtcgtcctctgggagatcgccactctggctgagcagccgtaccagggcctgtccaacgagcaagttcttcgtttcgtcatggagggcggccttctggacaagccggataactgccccgatatgctgtttgaacttatgcgcatgtgctggcagtacaaccccaagatgcggccctccttcctggagatcatcggaagcatcaaggatgagatggagcccagtttccaggaggtctccttctactacagcgaggagaacaagcctccagagccggaggagctggagatggagctggagctggagcccgagaacatggagagcgtcccgctggacccttcggcctcctcagcctccctgcctctgcctgaaagacactcaggacacaaggctgagaacggccctggcgtgctggttctccgtgccagttttgatgagagacagccttacgctcacatgaatgggggacgcgccaacgagagggccttgcctctgccccagtcctcgacctgctgatcctcgaccccgaagcacgtgcaaacagtaacgtgtgtgtgtgtgtgcgtgcgtgcgtgtgtgctcactcggtgggcggaggggggagcaggttgtaacaatctattcacaagcctcctgtatctcagtggatcttcagaactgcccttgctgcccacgggagtcggcttctctgcagtaaacacacttgggaccttccttttttcaatatgcaagcagctttttttatttccctacccaaacccttaactgacatgggcctctgcaaaccttaatgacagctcttaatagcaacaggacactcgagaattgagtctcctcattctctgccttttctctcttctgccttccctctctctcctctcccttcccacttccaggctctcctctcttttctccgcttcccagtggaaagcccagcggggaagcctttatttattttttttttaaatcaaattgacttaatggctgccctggggctcctcatcacacctgcctgagcaccataggtctttacaaaaaagaaaggaaaaaaacc

SEQ ID NO: 94 - protein, 1106 aa, Artificial Sequence
  Description of Artificial Sequence; note = synthetic construct
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 95 - DNA, 5598 bp, Artificial Sequence
  Description of Artificial Sequence; note = synthetic construct
ggcccctcagccctgctgcccagcacgagcctgtgctcgccctgcccaacgcagacagccagacccagggcggcccctctggcggctctgctcctcccgaaggatgcttggggagtgaggcgaagctgggcgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcactttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagccccaagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatggtaccccaagaaggatgtgagaggtggccgcttggagtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcac

What is claimed is:

1. A method of visualizing a cell in a mammal-comprising:
   a) administering a binding domain ligand into the mammal wherein:
      (i) the binding domain ligand comprises;
         (1) a label, and
         (2) maltose, biotin, glutathione, or a hyaluran polymer;
      (ii) the cell comprises a visualization molecule, comprising;
         (1) a transmembrane domain, and
         (2) a secretory or plasma membrane trafficking signal domain selected from the group consisting of HLA-B7, PDGFR, EGFR, IGFR, and Ig-k; and
         (3) a hinge domain recognized by an endogenous protease selected from the group consisting of a complement protease or a serine protease, and
         (4) an extracellular binding domain, wherein the binding domain ligand interacts with the binding domain, and
   b) visualizing the label of the binding domain ligand.

2. The method of claim 1, wherein the hinge domain comprises a factor IX site.

3. The method of claim 1, wherein the visualization of the label is in real time.

4. The method of claim 1, wherein the hinge domain is between the transmembrane domain and the binding domain ligand.

5. The method of claim 1, wherein cleavage of the hinge domain allows for the binding domain ligand to be visualized.

6. The method of claim 1, wherein the transmembrane domain comprises a single-pass or multi-pass transmembrane domain.

7. The method of claim 1, wherein the binding domain is selected from a maltose binding protein, avidin, streptavidin, glutathione-S-transferase (GST), and cd-44.

8. The method of claim 1, wherein the label comprises a fluorescent probe selected from the group consisting of cy5.5 or fitc, iodine, or gadolidium.

9. The method of claim 1, wherein the visualization molecule further comprises multiple binding domains.

10. The method of claim 1, wherein the visualization molecule further comprises an identification domain.

11. The method of claim 10, wherein the identification domain comprises an epitope.

12. The method of claim 11, wherein the epitope is selected from a hemagglutinin A epitope, a FLAG tag, and a myc epitope.

13. The method of claim 10, further comprising a second identification domain.

14. The method of claim 1, wherein the visualization of the label comprises performing a technique selected from non-invasive imaging, computed tomography, bioluminescence imaging, planar gamma camera imaging, single photon three-dimensional (3-D) emission computed tomography (SPECT) imaging, continuous-wavelength or time-domain light-based imaging, magnetic resonance imaging, fluorescence imaging, diffuse optical tomography, ultrasonography, Positron Emission Topography (PET) imaging, fluorescence correlation spectroscopy, in vivo two-photon microscopy, optical coherence tomography, speckle microscopy, nanocrystal labeling, and second harmonic imaging.

15. The method of claim 1, wherein the mammal is used as a disease model, wherein the disease is cancer, Alzheimer's, Grave's disease, Parkinson's, cystic fibrosis, muscular dystrophy, diabetes, or hamartoma.

16. The method of claim 1, wherein the visualization of the label identifies a tumor.

17. The method of claim 1, wherein the visualization label allows for monitoring treatment of diseases selected from cancer, Alzheimer's, Grave's disease, Parkinson's, cystic fibrosis, muscular dystrophy, diabetes, and hamartoma.

18. The method of claim 1, wherein the visualizing allows for cellular monitoring of transplanted cells.

19. The method of claim 18, wherein the transplanted cells are selected from the group consisting of pluripotent stem cells, multi potent stem cells, monopotent stem cells, differentiated cells, hematopoietic cells, mesenchymal cells, muscle cells, pancreatic cells, or neural cells, or any combination thereof.

20. The method of claim 1, wherein the visualization molecule is present in a subset of cells of the mammal.

21. The method of claim 1, wherein the visualization molecule is expressed in tissue selected from the group consisting of preneoplastic, neoplastic, endodermal, ectodermal, or mesenchymal tissue.

22. The method of claim 1, wherein expression of the visualization molecule is induced.

23. The method of claim 1, wherein the visualization molecule is constitutively expressed.

* * * * *